(12) United States Patent
Chang et al.

(10) Patent No.: US 11,525,010 B2
(45) Date of Patent: Dec. 13, 2022

(54) ANTIBODIES SPECIFIC FOR GUCY2C AND USES THEREOF

(71) Applicant: Pfizer Inc., New York, NY (US)

(72) Inventors: Chew Shun Chang, Quincy, MA (US);
Gurkan Guntas, Harvard, MA (US);
Madan Katragadda, Acton, MA (US);
Divya Mathur, Scarsdale, NY (US);
Adam Reid Root, Byfield, MA (US);
Lidia Mosyak, Newton, MA (US);
Edward Roland LaVallie, Harvard, MA (US)

(73) Assignee: PFIZER INC., New York, NY (US)

( * ) Notice: Subject to any disclaimer, the term of this patent is extended or adjusted under 35 U.S.C. 154(b) by 84 days.

(21) Appl. No.: 16/417,863

(22) Filed: May 21, 2019

(65) Prior Publication Data

US 2020/0010566 A1    Jan. 9, 2020

Related U.S. Application Data

(60) Provisional application No. 62/848,519, filed on May 15, 2019, provisional application No. 62/675,617, filed on May 23, 2018.

(51) Int. Cl.
*C07K 16/40* (2006.01)
*A61P 35/00* (2006.01)
*A61K 45/06* (2006.01)

(52) U.S. Cl.
CPC .............. *C07K 16/40* (2013.01); *A61P 35/00* (2018.01); *A61K 45/06* (2013.01)

(58) Field of Classification Search
CPC .......... C07K 16/40; A61P 35/00; A61K 45/06
See application file for complete search history.

(56) References Cited

U.S. PATENT DOCUMENTS

| | | | |
|---|---|---|---|
| 4,485,045 A | 11/1984 | Regen | |
| 4,544,545 A | 10/1985 | Ryan et al. | |
| 4,676,980 A | 6/1987 | Segal et al. | |
| 4,683,195 A | 7/1987 | Mullis et al. | |
| 4,683,202 A | 7/1987 | Mullis et al. | |
| 4,754,065 A | 6/1988 | Levenson et al. | |
| 4,777,127 A | 10/1988 | Suni et al. | |
| 4,800,159 A | 1/1989 | Mullis et al. | |
| 4,816,567 A | 3/1989 | Cabilly et al. | |
| 4,957,735 A | 9/1990 | Huang | |
| 5,013,556 A | 5/1991 | Woodle et al. | |
| 5,047,335 A | 9/1991 | Paulson et al. | |
| 5,219,740 A | 6/1993 | Miller et al. | |
| 5,278,299 A | 1/1994 | Wong et al. | |
| 5,422,120 A | 6/1995 | Kim | |
| 5,500,362 A | 3/1996 | Robinson et al. | |
| 5,510,261 A | 4/1996 | Goochee et al. | |
| 5,530,101 A | 6/1996 | Queen et al. | |
| 5,545,806 A | 8/1996 | Lonberg et al. | |
| 5,545,807 A | 8/1996 | Surani et al. | |
| 5,565,332 A | 10/1996 | Hoogenboom et al. | |
| 5,569,825 A | 10/1996 | Lonberg et al. | |
| 5,580,717 A | 12/1996 | Dower et al. | |
| 5,580,859 A | 12/1996 | Felgner et al. | |
| 5,585,089 A | 12/1996 | Queen et al. | |
| 5,591,828 A | 1/1997 | Bosslet et al. | |
| 5,625,126 A | 4/1997 | Lonberg et al. | |
| 5,633,425 A | 5/1997 | Lonberg et al. | |
| 5,661,016 A | 8/1997 | Lonberg et al. | |
| 5,693,761 A | 12/1997 | Queen et al. | |
| 5,693,762 A | 12/1997 | Queen et al. | |
| 5,733,743 A | 3/1998 | Johnson et al. | |
| 5,750,373 A | 5/1998 | Garrard et al. | |
| 5,807,715 A | 9/1998 | Morrison et al. | |
| 5,814,482 A | 9/1998 | Dubensky et al. | |
| 5,821,337 A | 10/1998 | Carter et al. | |
| 5,837,821 A | 11/1998 | Wu | |
| 5,866,692 A | 2/1999 | Shitara et al. | |
| 5,997,867 A | 12/1999 | Waldmann et al. | |
| 6,054,297 A | 4/2000 | Carter et al. | |
| 6,180,370 B1 | 1/2001 | Queen et al. | |
| 6,180,377 B1 | 1/2001 | Morgan et al. | |
| 6,210,671 B1 | 4/2001 | Co | |
| 6,265,150 B1 | 7/2001 | Terstappen et al. | |
| 6,331,415 B1 | 12/2001 | Cabilly et al. | |
| 6,350,861 B1 | 2/2002 | Co et al. | |
| 6,376,471 B1 | 4/2002 | Lawrence et al. | |

(Continued)

FOREIGN PATENT DOCUMENTS

| | | |
|---|---|---|
| EP | 0 345 242 A2 | 12/1989 |
| EP | 0 404 097 A2 | 6/1990 |

(Continued)

OTHER PUBLICATIONS

Barber et al., Recent Developments in Oncology Immunotherapy, Adverse Effects Part 2, Journal for Nurse Practitioners, 14, 4, 259-266 (Year: 2018).*
Almagro & Fransson, Humanization of antibodies, Frontiers in Bioscience 2008; 13: 1619-33 (Year: 2008).*
Alexandrov et al,"Signatures of mutational processes in human cancer", Nature 500:415-421 (2013).
Almenoff et al, "Ligand-based histochemical localization and capture of cells expressing heat-stable enterotoxin receptors", Molecular Microbiology 8(5):865-873 (1993).
Armour et al, "Recombinant human IgG molecules lacking Fcgamma receptor I binding and monocyte triggering activities", Eur. J. Immunol. 29:2613-2624 (1999).

(Continued)

*Primary Examiner* — Peter J Reddig
*Assistant Examiner* — Cheng Lu
(74) *Attorney, Agent, or Firm* — Ye Hua; Bryan C. Zielinski

(57) ABSTRACT

The present invention provides novel antibodies that specifically bind to GUCY2c and uses thereof in the treatment of cancer. The present invention further provides novel bispecific antibodies comprising such antibodies and uses thereof in the treatment of cancer.

24 Claims, 34 Drawing Sheets
Specification includes a Sequence Listing.

(56) References Cited

U.S. PATENT DOCUMENTS

| | | | |
|---|---|---|---|
| 6,413,942 | B1 | 7/2002 | Felgner et al. |
| 6,436,908 | B1 | 8/2002 | Koch et al. |
| 7,314,622 | B2 | 1/2008 | Arlen et al. |
| 9,884,921 | B2 | 2/2018 | May et al. |
| 2007/0004909 | A1 | 1/2007 | Johnson et al. |
| 2009/0060910 | A1 | 3/2009 | Johnson et al. |
| 2010/0174053 | A1 | 7/2010 | Johnson et al. |
| 2011/0110936 | A1 | 5/2011 | Nam et al. |
| 2013/0315923 | A1 | 11/2013 | Waldman et al. |
| 2016/0002357 | A1 | 1/2016 | May et al. |
| 2017/0233472 | A1 | 8/2017 | Barat et al. |

FOREIGN PATENT DOCUMENTS

| | | |
|---|---|---|
| EP | 0 524 968 B1 | 6/1995 |
| EP | 0 519 596 B1 | 2/2005 |
| GB | 2 200 651 B | 8/1988 |
| WO | 87/04462 A1 | 7/1987 |
| WO | 90/07936 A1 | 7/1990 |
| WO | 90/11092 A1 | 10/1990 |
| WO | 91/00360 A1 | 1/1991 |
| WO | 91/00904 A1 | 1/1991 |
| WO | 91/02805 A2 | 3/1991 |
| WO | 91/14445 A1 | 10/1991 |
| WO | 92/20373 A1 | 11/1992 |
| WO | 92/22653 A1 | 12/1992 |
| WO | 93/03769 A1 | 3/1993 |
| WO | 93/06213 A1 | 4/1993 |
| WO | 93/10218 A1 | 5/1993 |
| WO | 93/11161 A1 | 6/1993 |
| WO | 93/11230 A1 | 6/1993 |
| WO | 93/19191 A1 | 9/1993 |
| WO | 93/25234 A1 | 12/1993 |
| WO | 93/25698 A1 | 12/1993 |
| WO | 94/03622 A1 | 2/1994 |
| WO | 94/12649 A2 | 6/1994 |
| WO | 94/23697 A1 | 10/1994 |
| WO | 94/28938 A1 | 12/1994 |
| WO | 95/00655 A1 | 1/1995 |
| WO | 95/07994 A2 | 3/1995 |
| WO | 95/11984 A2 | 5/1995 |
| WO | 95/13796 A1 | 5/1995 |
| WO | 95/30763 A2 | 11/1995 |
| WO | 96/17072 A2 | 6/1996 |
| WO | 97/42338 A1 | 11/1997 |
| WO | 99/58572 A1 | 11/1999 |
| WO | 01/27160 A1 | 4/2001 |
| WO | 2004/058184 A2 | 7/2004 |
| WO | 2010/065293 A1 | 6/2010 |
| WO | 2012/059882 A2 | 5/2012 |
| WO | 2013/055809 A1 | 4/2013 |
| WO | 2015/015448 A2 | 2/2015 |
| WO | 2016/166629 A1 | 10/2016 |
| WO | 2017/100540 A2 | 6/2017 |

OTHER PUBLICATIONS

Avery et al, "Establishing in vitro in vivo correlations to screen monoclonal antibodies for physicochemical properties related to favorable human pharmacokinetics", mAbs 10(2):244-255 (2018).
Balint et al, "Antibody engineering by parsimonious mutagenesis", Gene 137:109-118 (1993).
Barbas et al, "In vitro evolution of a neutralizing human antibody to human immunodeficiency virus type 1 to enhance affinity and broaden strain cross-reactivity", Proceedings of the National Academy of Sciences of the United States of America 91:3809-3813 (1994).
Bird et al, "Single-Chain Antigen-Binding Proteins", Science 242:423-426 (1988).
Bloom et al, "Intrachain disulfide bond in the core hinge region of human IgG4", Protein Science 6:407-415 (1997).
Boerner et al, "Production of Antigen-Specific Human Monoclonal Antibodies from In Vitro-Primed Human Splenocytes", The Journal of Immunology 147:86-95 (1991).
Bowie et al, "Deciphering the Message in Protein Sequences: Tolerance to Amino Acid Substitutions", Science 247:1306-1310 (1990).
Boyd et al, "The Effect of the Removal of Sialic Acid, Galactose and Total Carbohydrate on the Functional Activity of Campath-1H", Molecular Immunology 32(17/18):1311-1318 (1995).
Brenner et al, "Colorectal cancer", Lancet 383:1490-1502 (2014).
Brinkmann et al, "Phage display of disulfide-stabilized Fv fragments", Journal of Immunological Methods 182:41-50 (1995).
Brown et al, "Tumor-specific Genetically Engineered Murine/Human Chimeric Monoclonal Antibody", Cancer Research 47:3577-3583 (1987).
Buc et al, "Guanylyl cyclase C as a reliable immunohistochemical marker and its ligand *Escherichia coli* heat-stable enterotoxin as a potential protein-delivering vehicle for colorectal cancer cells", European Journal of Cancer 41:1618-1627 (2005).
Buck et al, "Monoclonal Antibodies Specific for Cell Culture Mycoplasmas", In Vitro 18(4):377-381 (1982).
Canfield et al, "The Binding Affinity of Human IgG for its High Affinity Fc Receptor Is Determined by Multiple Amino Acids in the CH2 Domain and Is Modulated by the Hinge Region", J. Exp. Med. 173:1483-1491 (1991).
Capel et al, "Heterogeneity of Human IgG Fc Receptors", Immunomethods 4:25-34 (1994).
Carrithers et al, "*Escherichia coli* Heat-Stable Toxin Receptors in Human Colonic Tumors", Gastroenterology 107:1653-1661 (1994).
Carrithers et al, "*Escherichia coli* Heat-Stable Enterotoxin Receptors", Dis Colon Rectum 39:171-181 (1996).
Carrithers, "Diarrhea or colorectal cancer: Can bacterial toxins serve as a treatment for colon cancer?", Proceedings of the National Academy of Sciences of the United States of America 100(6):3018-3020 (2003).
Chelius et al, "Identification and Characterization of Deamidation Sites in the Conserved Regions of Human Immunoglobulin Gamma Antibodies", Anal. Chem. 77(18):6004-6011 (2005).
Chetty et al, "CD3: Structure, Function, and Role of Immunostaining in Clinical Practice", Journal of Pathology 173:303-307 (1994).
Chothia et al, "Conformations of immunoglobulin hypervariable regions", Nature 342:877-883 (1989).
Clackson et al, "Making antibody fragments using phage display libraries", Nature 352:624-628 (1991).
Clynes et al, "Fc receptors are required in passive and active immunity to melanoma", Proceedings of the National Academy of Sciences of the United States of America 95:652-656 (1998).
Connelly et al, "In Vivo Gene Delivery and Expression of Physiological Levels of Functional Human Factor VIII in Mice", Human Gene Therapy 6:185-193 (1995).
Connor et al, "Monoclonal Antibody and Liposomes", Pharmac. Ther. 28:341-365 (1985).
Curiel et al, "High-Efficiency Gene Transfer Mediated by Adenovirus Coupled to DNA-Polylysine Complexes", Human Gene Therapy 3:147-154 (1992).
Daugherty et al, "Polymerase chain reaction facilitates the cloning, CDR-grafting, and rapid expression of a murine monoclonal antibody directed against the CD18 component of leukocyte integrins", Nucleic Acids Research 19(9):2471-2476 (1991).
De Haas et al, "Fcγ receptors of phagocytes", J Lab Clin Med 126:330-341 (1995).
Ellman et al, "Biosynthetic Method for Introducing Unnatural Amino Acids Site-Specifically into Proteins", Methods in Enzymology 202:301-336 (1991).
Eppstein et al, "Biological activity of liposome-encapsulated murine interferon γ is mediated by a cell membrane receptor", Proceedings of the National Academy of Sciences of the United States of America 82:3688-3692 (1985).
Findeis et al, "Targeted delivery of DNA for gene therapy via receptors", Trends in Biotechnology 11(5):202-205 (1993).
Gazzano-Santoro et al, "A non-radioactive complement-dependent cytotoxicity assay for anti-CD20 monoclonal antibody", Journal of Immunological Methods 202:163-171 (1997).

(56) References Cited

OTHER PUBLICATIONS

Geisse et al, "Eukaryotic Expression Systems: A Comparison", Protein Expression and Purification 8:271-282 (1996).
Gentle et al, "Direct Production of Proteins with N-Terminal Cysteine for Site-Specific Conjugation", Bioconjugate Chem. 15:658-663 (2004).
Griffiths et al, "Human anti-self antibodies with high specificity from phage display libraries", The EMBO Journal 12(2):725-734 (1993).
Guarino et al, "Binding of E. coli Heat-Stable Enterotoxin to Rat Intestinal Brush Borders and to Basolateral Membranes", Digestive Diseases and Sciences 32(9):1017-1026 (1987).
Guyer et al, "Immunoglobulin Binding by Mouse Intestinal Epithelial Cell Receptors", The Journal of Immunology 117(2):587-593 (1976).
Hamra et al, "Uroguanylin: Structure and activity of a second endogenous peptide that stimulates intestinal guanylate cyclase", Proceedings of the National Academy of Sciences of the United States of America 90:10464-10468 (1993).
Hawkins et al, "Selection of Phage Antibodies by Binding Affinity: Mimicking Affinity Maturation", J. Mol. Biol. 226:889-896 (1992).
Holliger et al, ""Diabodies": Small bivalent and bispecific antibody fragments", Proceedings of the National Academy of Sciences of the United States of America 90:6444-6448 (1993).
Hoogenboom et al, "By-passing Immunisation: Human Antibodies from Synthetic Repertoires of Germline VH Gene Segments Rearranged in Vitro", J. Mol. Biol. 227:381-388 (1992).
Hötzel et al, "A strategy for risk mitigation of antibodies with fast clearance", mAbs 4(6):753-760 (2012).
Humphreys et al, "Formation of dimeric Fabs in *Escherichia coli*: effect of hinge size and isotype, presence of interchain disulphide bond, Fab' expression levels, tail piece sequences and growth conditions", Journal of Immunological Methods 209:193-202 (1997).
Dahlén et al, "Bispecific antibodies in cancer immunotherapy", Therapeutic Advances in Vaccines and Immunotherapy 6(1):3-17 (2018).
PCT International Search Report and Written Opinion for International Application No. PCT/IB2019/054187 dated Jan. 20, 2020.
Jakobovits et al, "Germ-line transmission and expression of a human-derived yeast artificial chromosome", Nature 362:255-258 (1993).
Jakobovits et al, "Analysis of homozygous mutant chimeric mice: Deletion of the immunoglobulin heavy-chain joining region blocks B-cell development and antibody production", Proceedings of the National Academy of Sciences of the United States of America 90:2551-2555 (1993).
Jefferis et al, "Glycosylation of Antibody Molecules: Structural and Functional Significance", Chem. Immunol. 65:111-128 (1997).
Jefferis et al, "IgG-Fc-mediated effector functions: molecular definition of interaction sites for effector ligands and the role of glycosylation", Immunological Reviews 163:59-76 (1998).
Jolly, "Viral vector systems for gene therapy", Cancer Gene Therapy 1(1):51-64 (1994).
Jones et al, "Replacing the complementarity-determining regions in a human antibody with those from a mouse", Nature 321:522-525 (1986).
Junutula et al, "Site-specific conjugation of a cytotoxic drug to an antibody improves the therapeutic index", Nature Biotechnology 26(8):925-932 (2008).
Kaplitt et al, "Long-term gene expression and phenotypic correction using adeno-associated virus vectors in the mammalian brain", Nature Genetics 8:148-154 (1994).
Kaufman, "Overview of Vector Design for Mammalian Gene Expression", Molecular Biotechnology 16:151-160 (2000).
Kim et al, "Localization of the site of the murine IgG1 molecule that is involved in binding to the murine intestinal Fc receptor", Eur. J. Immunol. 24:2429-2434 (1994).
Kimura et al, "Retroviral Delivery of DNA into the Livers of Transgenic Mice Bearing Premalignant Hepatocellular Carcinomas", Human Gene Therapy 5:845-852 (1994).
Knoop et al, "Pharmacologic Action of *Escherichia coli* Heat-Stable (STa) Enterotoxin", Journal of Pharmacological and Toxicological Methods 28:67-72 (1992).
Kohler et al, "Continuous cultures of fused cells secreting antibody of predefined specificity", Nature 256:495-497 (1975).
Lawrence et al, "Mutational heterogeneity in cancer and the search for new cancer-associated genes", Nature 499:214-218 (2013).
Lobuglio et al, "Mouse/human chimeric monoclonal antibody in man: Kinetics and immune response", Proceedings of the National Academy of Sciences of the United States of America 86:4220-4224 (1989).
Lonberg et al, "Human Antibodies from Transgenic Mice", Intern. Rev. Immunol. 13:65-93 (1995).
Lund et al, "Multiple Interactions of IgG with Its Core Oligosaccharide Can Modulate Recognition by Complement and Human Fc$\gamma$ Receptor I and Influence the Synthesis of Its Oligosaccharide Chains", The Journal of Immunology 157:4963-4969 (1996).
Mac Callum et al, "Antibody-antigen Interactions: Contact Analysis and Binding Site Topography", Journal of Molecular Biology 262:732-745 (1996).
Makabe et al, "Thermodynamic Consequences of Mutations in Vernier Zone Residues of a Humanized Anti-human Epidermal Growth Factor Receptor Murine Antibody, 528", The Journal of Biological Chemistry 283(2):1156-1166 (2008).
Makrides, "Components of Vectors for Gene Transfer and Expression in Mammalian Cells", Protein Expression and Purification 17:183-202 (1999).
Mann et al, "Mice Lacking the Guanlyly Cyclase C Receptor Are Resistant to STa-Induced Intestinal Secretion", Biochemical and Biophysical Research Communications 239:463-466 (1997).
Marks et al, "By-passing Immunization: Human Antibodies from V-gene Libraries Displayed on Phage", J. Mol. Biol. 222:581-597 (1991).
Marks et al, "By-passing Immunization: Building High Affinity Human Antibodies by Chain Shuffling", Bio/Technology 10:779-783 (1992).
Mc Cafferty et al, "Phage antibodies: filamentous phage displaying antibody variable domains", Nature 348:552-554 (1990).
Milstein et al, "Hybrid hybridomas and their use in immunohistochemistry", Nature 305:537-539 (1983).
Morgan et al, "The N-terminal end of the CH2 domain of chimeric human IgG1 anti-HLA-DR is necessary for C1q, Fc$\gamma$RI and Fc$\gamma$RIII binding", Immunology 86:319-324 (1995).
Morrison et al, "Chimeric human antibody molecules: Mouse antigen-binding domains with human constant region domains", Proceedings of the National Academy of Sciences of the United States of America 81:6851-6855 (1984).
NCBI GenBank Accession No. NM_000733 *Homo sapiens* CD3e molecule (CD3E), mRNA (May 31, 2018).
NCBI GenBank Accession No. NM_004963 *Homo sapiens* guanylate cyclase 2C (GUCY 2C), mRNA (Jun. 3, 2018).
NCBI GenPept Accession No. NP-004954 heat-stable enterotoxin receptor precursor [*Homo sapiens*] (Jun. 3, 2018).
North et al, "A New Clustering of Antibody CDR Loop Conformations", Journal of Molecular Biology 406:228-256 (2011).
Padlan et al, "Identification of specificity-determining residues in antibodies", FASEB Journal 9:133-139 (1995).
Peeters et al, "Production of antibodies and antibody fragments in plants", Vaccine 19:2756-2761 (2001).
Philip et al, "Efficient and Sustained Gene Expression in Primary T Lymphocytes and Primary and Cultured Tumor Cells Mediated by Adeno-Associated Virus Plasmid DNA Complexed to Cationic Liposomes", Molecular and Cellular Biology 14(4):2411-2418 (1994).
Pitari et al, "Bacterial enterotoxins are associated with resistance to colon cancer", Proceedings of the National Academy of Sciences of the United States of America 100(5):2695-2699 (2003).
Poljak, "Production and structure of diabodies: The first crystal structure of a diabody, a bivalent antibody fragment, confirms previous predicted structures and techniques for generating bispecific bivalent antibody fragments of considerable therapeutic potential.", Structure 2:1121-1123 (1994).

(56) References Cited

OTHER PUBLICATIONS

Pollock et al, "Transgenic milk as a method for the production of recombinant antibodies", Journal of Immunological Methods 231:147-157 (1999).
Rao, "Toxins which activate guanylate cyclase: heat-stable enterotoxins", Ciba Foundation Symposium 112:74-93 (1985).
Ravetch et al, "Fc Receptors", Annu. Rev. Immunol. 9:457-492 (1991).
Riechmann et al, "Reshaping human antibodies for therapy", Nature 332:323-327 (1988).
Schafer et al, "Prediction of well-conserved HIV-1 ligands using a matrix-based algorithm, EpiMatrix", Vaccine 16(19):1880-1884 (1998).
Schier et al, "Identification of functional and structural amino-acid residues by parsimonious mutagenesis", Gene 169:147-155 (1996).
Shaw et al, "Characterization of a Mouse/Human Chimeric Monoclonal Antibody (17-1A) to a Colon Cancer Tumor-Associated Antigen", The Journal of Immunology 138(12):4534-4538 (1987).
Sheets et al, "Efficient construction of a large nonimmune phage antibody library: The production of high-affinity human single-chain antibodies to protein antigens", Proceedings of the National Academy of Sciences of the United States of America 95:6157-6162 (1998).
Shields et al, "High Resolution Mapping of the Binding Site on Human IgG1 for FcγRI, FcγRII, FcγRIII, and FcRn and Design of IgG1 Variants with Improved Binding to the FcγR", The Journal of Biological Chemistry 276(9):6591-6604 (2001).
Siegel et al, "Cancer Statistics, 2016", CA Cancer J Clin 66(1):7-30 (2016).
Smith-Garvin et al, "T Cell Activation", Annu. Rev. Immunol. 27:591-619 (2009).
Suresh et al, "Bispecific Monoclonal Antibodies from Hybrid Hybridomas", Methods in Enzymology 121:210-228 (1986).
Tanaka et al, "N-terminal glycine-specific protein conjugation catalyzed by microbial transglutaminase", FEBS Letters 579:2092-2096 (2005).
Tao et al, "Studies of Aglycosylated Chimeric Mouse-Human IgG: Role of Carbohydrate in the Structure and Effector Functions Mediated by the Human IgG Constant Region", The Journal of Immunology 143(8):2595-2601 (1989).
Taylor et al, "A transgenic mouse that expresses a diversity of human sequence heavy and light chain immunoglobulins", Nucleic Acids Research 20(23):6287-6295 (1992).
Tiller et al, "Efficient generation of monoclonal antibodies from single human B cells by single cell RT-PCR and expression vector cloning", Journal of Immunological Methods 329:112-124 (2008).
Townsend et al, "Augmented Binary Substitution: Single-pass CDR germ-lining and stabilization of therapeutic antibodies", Proceedings of the National Academy of Sciences of the United States of America 112(50):15354-15359 (2015).
Umana et al, "Engineered glycoforms of an antineuroblastoma IgG1 with optimized antibody-dependent cellular cytotoxic activity", Nature Biotechnology 17:176-180 (1999).
Urbanski et al, "Internalization of E. coli ST mediated by guanylyl cyclase C in T84 human colon carcinoma cells", Biochimica et Biophysica Acta 1245:29-36 (1995).
Vaughan et al, "Human Antibodies with Sub-nanomolar Affinities Isolated from a Large Non-immunized Phage Display Library", Nature Biotechnology 14:309-314 (1996).
Verhoeyen et al, "Reshaping Human Antibodies: Grafting an Antilysozyme Activity", Science 239:1534-1536 (1988).
Vita et al, "The immune epitope database (IEDB) 3.0", Nucleic Acids Research 43(Database Issue):D405-D412 (2015).
Vogelstein et al, "Cancer Genome Landscapes", Science 339:1546-1558 (2013).
Wang et al, "A Systematic Assessment of MHC Class II Peptide Binding Predictions and Evaluation of a Consensus Approach", PLoS Computational Biology 4(4):e1000048 (2008).
Wang et al, "Peptide binding predictions for HLA DR, DP and DQ molecules", BMC Bioinformatics 11:568 (2010).
Ward et al, "Binding activities of a repertoire of single immunoglobulin variable domains secreted from Escherichia coli", Nature 341:544-546 (1989).
Waterhouse et al, "Combinatorial infection and in vivo recombination: a strategy for making large phage antibody repertoires", Nucleic Acids Research 21(9):2265-2266 (1993).
Wiegand et al, "Human guanylin: cDNA isolation, structure, and activity", FEBS 311(2):150-154 (1992).
Winter et al, "Man-made antibodies", Nature 349:293-299 (1991).
Winter et al, "Making Antibodies by Phage Display Technology", Ann. Rev. Immunol. 12:433-455 (1994).
Wittwer et al, "Glycosylation at Asn-184 Inhibits the Conversion of Single-Chain to Two-Chain Tissue-Type Plasminogen Activator by Plasmin", Biochemistry 29:4175-4180 (1990).
Woffendin et al, "Nonviral and viral delivery of a human immunodeficiency virus protective gene into primary human T cells", Proceedings of the National Academy of Sciences of the United States of America 91:11581-11585 (1994).
Wright et al, "Effect of glycosylation on antibody function: implications for genetic engineering", Trends in Biotechnology (TibTECH) 15:26-32 (1997).
Wu et al, "Receptor-mediated Gene Delivery and Expression in Vivo", The Journal of Biological Chemistry 263(29):14621-14624 (1988).
Wu et al, "Targeting Genes: Delivery and Persistent Expression of a Foreign Gene Driven by Mammalian Regulatory Elements in Vivo", The Journal of Biological Chemistry 264(29):16985-16987 (1989).
Wu et al, "Receptor-mediated Gene Delivery in Vivo: Partial Correction of Genetic Analbuminemia in Nagase Rats", The Journal of Biological Chemistry 266(22):14338-14342 (1991).
Wu et al, "Incorporation of Adenovirus into a Ligand-based DNA Carrier System Results in Retention of Original Receptor Specificity and Enhances Targeted Gene Expression", The Journal of Biological Chemistry 269(15):11542-11546 (1994).
Wyss et al, "The structural role of sugars in glycoproteins", Current Opinion in Biotechnology 7:409-416 (1996).
Xu et al, "Addressing polyspecificity of antibodies selected from an in vitro yeast presentation system: a FACS-based, high-throughput selection and analytical tool", Protein Engineering, Design & Selection 26(10):663-670 (2013).
Yelton et al, "Affinity Maturation of the BR96 Anti-Carcinoma Antibody by Codon-Based Mutagenesis", The Journal of Immunology 155:1994-2004 (1995).
Yin et al, "Therapeutic outcomes, assessments, risk factors and mitigation efforts of immunogenicity of therapeutic protein products", Cellular Immunology 295(2):118-126 (2015).
Yun et al, "In Vivo Antitumor Activity of Anti-CD3-induced Activated Killer Cells", Cancer Research 49:4770-4774 (1989).
Huston et al, "Protein engineering of antibody binding sites: Recovery of specific activity in an anti-digoxin single-chain Fv analogue produced in Escherichia coli", Proceedings of the National Academy of Sciences of the United States of America 85:5879-5883 (1988).
Hwang et al, "Hepatic uptake and degradation of unilamellar sphingomyelin/cholesterol liposomes: A kinetic study", Proceedings of the National Academy of Sciences of the United States of America 77(7):4030-4034 (1980).
Idusogie et al, "Mapping of the C1q Binding Site on Rituxan, a Chimeric Antibody with a Human IgG1 Fc", The Journal of Immunology 164:4178-4184 (2000).
Jackson et al, "In Vitro Antibody Maturation", The Journal of Immunology 154:3310-3319 (1995).
Zenke et al, "Receptor-mediated endocytosis of transferrin-polycation conjugates: An efficient way to introduce DNA into hematopoietic cells", Proceedings of the National Academy of Sciences of the United States of America 87:3655-3659 (1990).
Zhang et al, "Recombinase-Mediated Cassette Exchange (RMCE) for Monoclonal Antibody Expression in the Commercially Relevant CHOK1SV Cell Line", Biotechnology Progress 31(6):1645-1656 (2015).

\* cited by examiner

GUCY2c-0247 to human naive T cells

GUCY2c-1608 to human naive T cells

T84 CTL Assay

LS1034

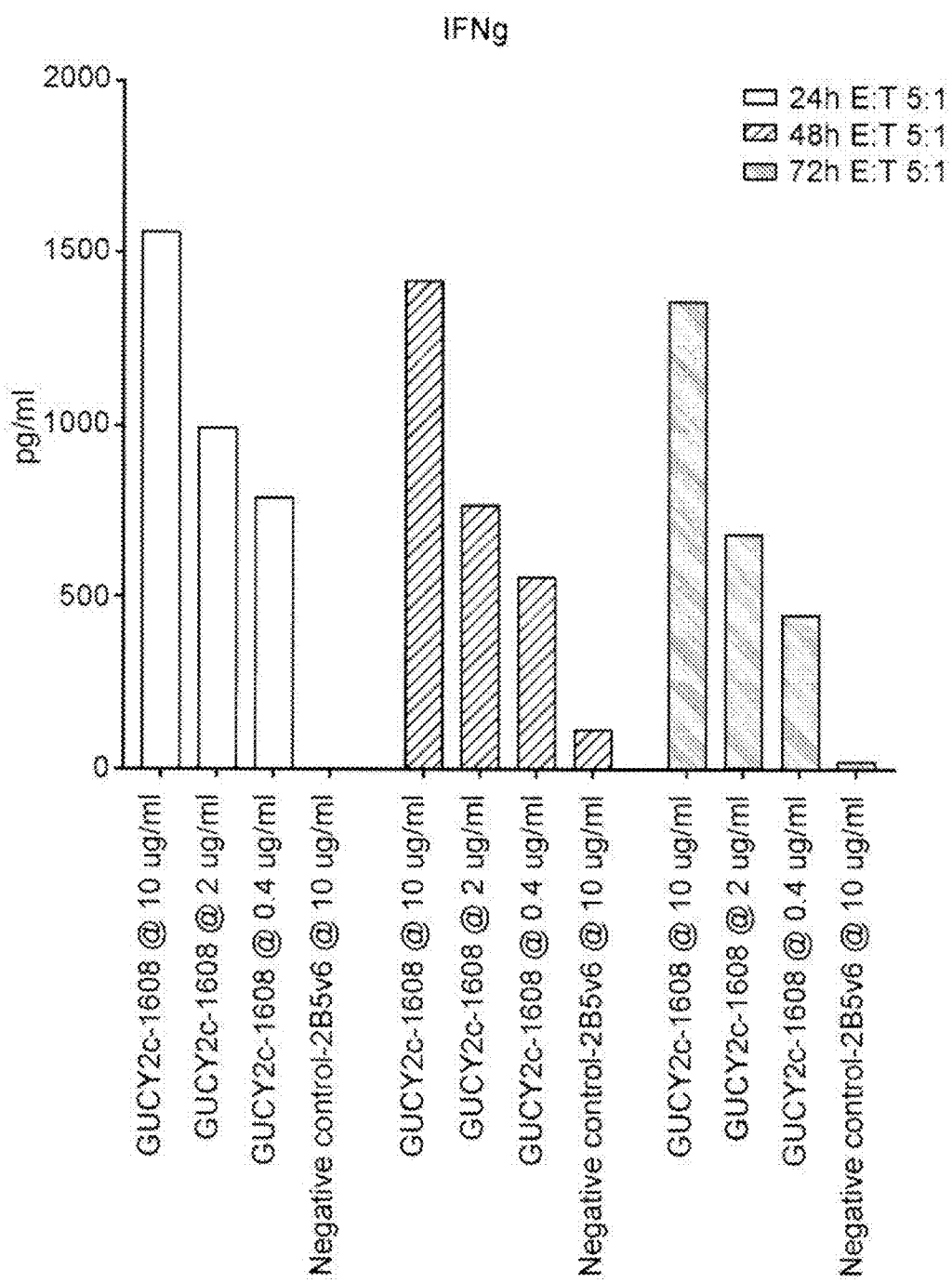

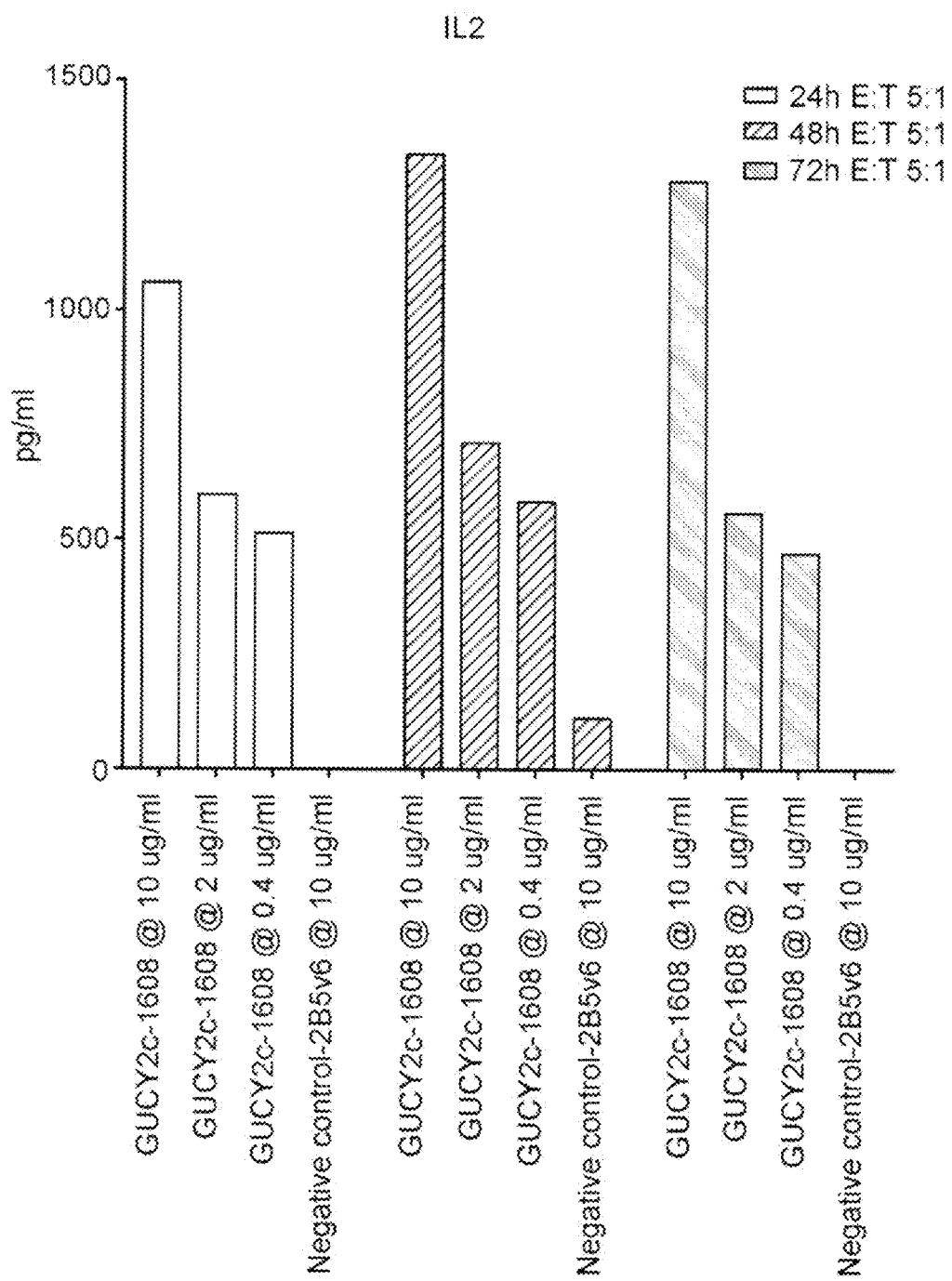

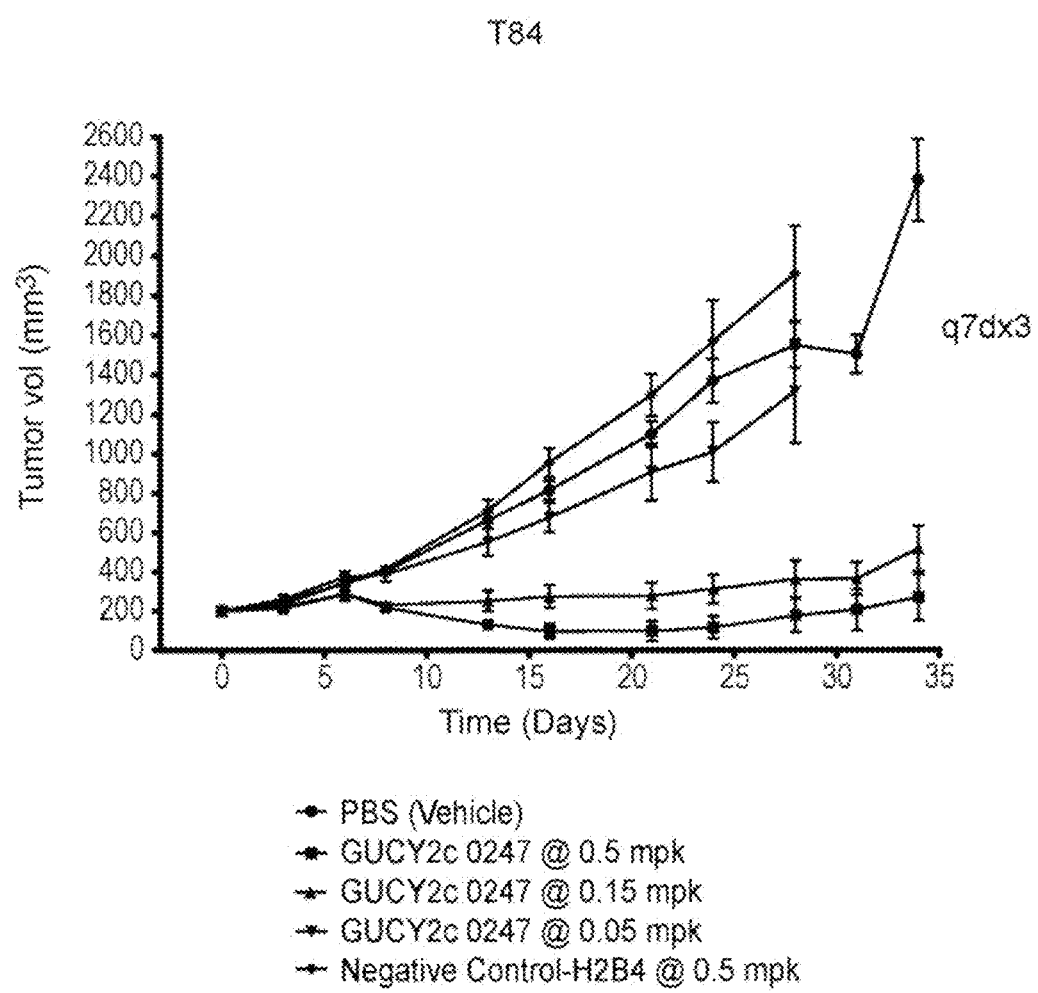

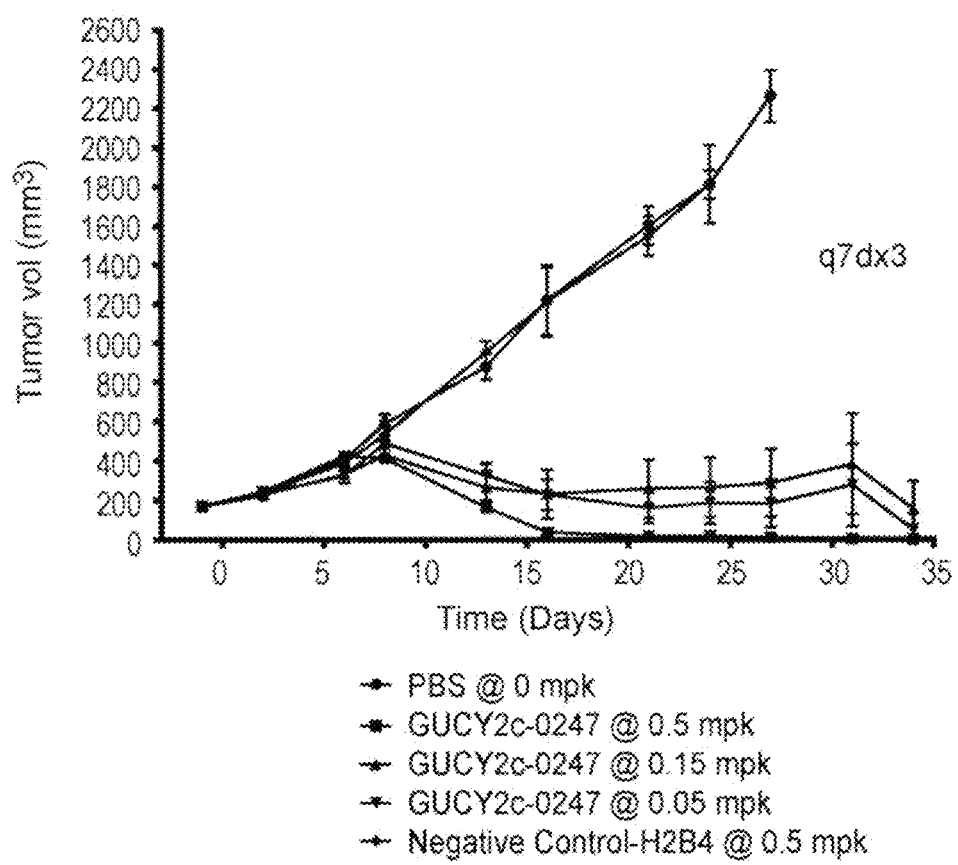

PDX-CRX-12213

PDX-CRX-24225

ANTIBODIES SPECIFIC FOR GUCY2C AND USES THEREOF

RELATED APPLICATIONS

This application claims the benefit of U.S. Provisional Application No. 62/675,617, filed May 23, 2018, and U.S. Provisional Application No. 62/848,519, filed May 15, 2019.

SEQUENCE LISTING

This application is being filed electronically via EFS-Web and includes an electronically submitted sequence listing in .txt format. The .txt file contains a sequence listing entitled "PC72377-PRV2_Sequence_Listing_ST25_05142019.txt" created on May 14, 2019, and having a size of 738 KB. The sequence listing contained in this .txt file is part of the specification and is incorporated herein by reference in its entirety.

FIELD OF THE INVENTION

The present invention relates to antibodies, e.g., full length antibodies or antigen binding fragments thereof, that specifically bind to GUCY2c (Guanylyl cyclase C) and/or CD3 (Cluster of Differentiation 3). The present invention further relates to bispecific antibodies that specifically bind to CD3 and a tumor cell antigen, (e.g., bispecific antibodies that specifically bind to CD3 and GUCY2c). The present invention also pertains to related molecules, e.g., nucleic acids which encode such antibodies or bispecific antibodies, compositions, and related methods, e.g., methods for producing and purifying such antibodies and bispecific antibodies, and their use in diagnostics and therapeutics.

BACKGROUND OF THE INVENTION

Cancer is a leading cause of death worldwide, accounting for more than 7 million deaths each year. Cancer mortality is nearly universally related to the spread of primary tumors to distant sites forming metastases and ultimately leading to death. This is particularly true for gastrointestinal cancer, including adenocarcinoma of the esophagus, stomach, colon, and rectum. Colorectal cancer (CRC) remains the fourth most diagnosed cancer, and the second leading cause of cancer death in the United States (Siegel R L, Miller K D, Jemal A. Cancer statistics, 2016. CA Cancer J Clin., 66:7-30, 2016). Worldwide, colorectal cancer accounts for as many as 1.2 million new cases and 600,000 deaths per year (Brenner H, Kloor M, Pox C P. Colorectal cancer. Lancet, 383:1490-502, 2014).

Guanylyl cyclase C (GUCY2c) (also known as STAR, ST Receptor, GUC2C, GUCY2C, GC-C and GCC) is a transmembrane cell surface receptor that functions in the maintenance of intestinal fluid, electrolyte homeostasis and cell proliferation (Carrithers et al., Proc Natl Acad Sci USA 100: 3018-3020, 2003; Mann et al., Biochem Biophys Res Commun 239: 463-466, 1997; Pitari et al., Proc Natl Acad Sci USA 100: 2695-2699, 2003); GenBank Accession No. NM.sub.-004963, and GenPept Accession No. NP-004954). This function is mediated through binding of guanylin (Wiegand et al. FEBS Lett. 311:150-154, 1992) and uroguanylin (Hamra et al. Proc Natl Acad Sci USA 9(22):10464-10468, 1993). GUCY2c also is a receptor for heat-stable enterotoxin (ST) which is a peptide produced by *E. coli*, as well as other infectious organisms (Rao, M. C. Ciba Found. Symp. 112:74-93, 1985; Knoop F. C. and Owens, M. J. Pharmacol. Toxicol. Methods 28:67-72, 1992). Binding of ST to GUCY2c activates a signal cascade that results in enteric disease, e.g., diarrhea.

GUCY2c has been characterized as a protein involved in cancers, including colorectal cancer, pancreatic cancer, gastric cancer, hepatic cancer, and esophageal cancer (Carrithers et al., Dis Colon Rectum 39:171-181, 1996; Buc et al. Eur J Cancer 41: 1618-1627, 2005; Carrithers et al., Gastroenterology 107: 1653-1661, 1994; Urbanski et al., Biochem Biophys Acta 1245: 29-36, 1995).

As a cell surface protein, GUCY2c can serve as a therapeutic target for receptor binding proteins such as antibodies or ligands. GUCY2c is expressed on the apical side of epithelial cells lining the mucosa of the small intestine, large intestine and rectum (Carrithers et al., Dis Colon Rectum 39: 171-181, 1996). GUCY2c expression is maintained upon neoplastic transformation of intestinal epithelial cells, with expression in all primary and metastatic colorectal tumors (Carrithers et al., 1996; Buc et al.; Carrithers et al., 1994). GUCY2c expression has also been detected in esophageal cells diagnosed as Barrett's esophagus, esophageal cancer and gastric cancer.

There remains a need for molecules and/or compositions which can specifically target and specifically bind to metastasized colorectal cancer cells. There is a need for improved methods of treating individuals who are suspected of suffering from colorectal cancer, especially individuals who are suspected of suffering from metastasis of colorectal cancer cells.

Various strategies have been developed to generate bispecific antibodies capable of T cell recruitment to mediate tumor cell killing. Such bispecific antibodies can make a bridge between a tumor cell and an effector cell of the human immune system (NK cell, T cell, monocyte, macrophage or granulocyte) thus permitting specific killing of the tumor cell. While such bispecific antibodies have proved to be favorable for therapeutic applications, e.g., for therapeutic concepts for the treatment of tumors, there remains a need for bispecific antibodies that would target GUCY2c positive tumor cells in a highly potent and specific manner. Such a molecule would be useful as a therapeutic agent in cases of GI malignancies, in the treatment of cancer and in the detection of GUCY2c on cells.

SUMMARY OF THE INVENTION

The present invention provides antibodies, including bispecific antibodies wherein the antibodies that specifically bind to GUCY2c. The invention further provides bispecific antibodies that are capable of binding to GUCY2c and to CD3.

In one aspect, the invention provides antibody which specifically binds to guanylyl cyclase C (GUCY2c), wherein the antibody comprises: (a) a heavy chain variable (VH) region comprising a VH complementarity determining region one (VH CDR1), a VH complementarity determining region two (VH CDR2), and a VH complementarity determining region three (VH CDR3) of the VH sequence shown in SEQ ID NO: 11, 19, 26, 33, 41, 48, 52, 57, 60, 62, 64, 65, 67, 69, 71, or 73; and/or (b) a light chain variable (VL) region comprising a VL complementarity determining region one (VL CDR1), a VL complementarity determining region two (VL CDR2), and a VL complementarity determining region three (VL CDR3) of the VL sequence shown in SEQ ID NO: 92, 100, 104, 106, 112, 119, 125, 129, 134, 136, 137, 138, 140, 143, 145, 147, 150, 152, 156, 158, 160, 162, 166, 170, 171, 172, 173, 174, or 175.

In one embodiment, the invention provides an antibody which specifically binds to GUCY2c, wherein the antibody comprises: (a) a VH region comprising (i) a VH CDR1 comprising a sequence of SEQ ID NO: 12, 20, 27, 34, 42, 74, 257, 258, 259, 260, or 261; (ii) a VH CDR2 comprising a sequence of SEQ ID NO: 13, 21, 28, 35, 43, 53, 66, 68, 70, 72, 75, 262, 263, 264, 265, 266, or 267; and (iii) a VH CDR3 comprising a sequence of SEQ ID NO: 14, 22, 29, 36, or 44; and/or (b) a VL region comprising (i) a VL CDR1 comprising a sequence of SEQ ID NO: 93, 101, 105, 107, 113, 120, 148, 153, 163, or 167; (ii) a VL CDR2 comprising a sequence of SEQ ID NO: 78, 94, 102, 108, 114, 141, 144, 146, 149, 151, 157, 159, 161, 164, or 168; and (iii) a VL CDR3 comprising a sequence of SEQ ID NO: 95, 109, 115, 121, 142, 154, 165, or 169.

In one embodiment, the invention provides an antibody, wherein: (a) the VH region comprises (i) a VH CDR1 comprising the sequence of SEQ ID NO: 74; (ii) a VH CDR2 comprising the sequence of SEQ ID NO: 75; and iii) a VH CDR3 comprising the sequence of SEQ ID NO: 29; and/or (b) the VL region comprises (i) a VL CDR1 comprising the sequence of SEQ ID NO: 148; (ii) a VL CDR2 comprising the sequence of SEQ ID NO: 149; and (iii) a VL CDR3 comprising the sequence of SEQ ID NO: 142.

In another embodiment, the invention provides an antibody, wherein: (a) the VH region comprises SEQ ID NO: 11, 19, 26, 33, 41, 48, 52, 57, 60, 62, 64, 65, 67, 69, 71, or 73; and/or (b) the VL region comprises SEQ ID NO: 92, 100, 104, 106, 112, 119, 125, 129, 134, 136, 137, 138, 140, 143, 145, 147, 150, 152, 156, 158, 160, 162, 166, 170, 171, 172, 173, 174, or 175.

In yet another embodiment, the invention provides an antibody, wherein the VH region comprises the sequence of SEQ ID NO: 73; and wherein the VL region comprises the sequence of SEQ ID NO: 147.

In one embodiment, the invention provides an antibody, wherein the VH region comprises the sequence of SEQ ID NO: 73, or a variant thereof with one or several conservative amino acid substitutions in residues that are not within the VH region; and/or wherein the VL region comprises the sequence of SEQ ID NO: 147, or a variant thereof with one or several conservative amino acid substitutions in amino acids that are not within the VL region.

In one embodiment, the invention provides an antibody, wherein the antibody is selected from the group consisting of a Fab fragment, a Fab' fragment, a F(ab')$_2$ fragment, an Fd fragment, an Fv fragment, a single chain Fv (scFv) fragment, a disulfide stabilized Fv (dsFv) fragment, a single domain antibody (dAb) fragment, a monoclonal antibody, a chimeric antibody, a bispecific antibody, a trispecific antibody, a multispecific antibody, a bispecific heterodimeric diabody, a bispecific heterodimeric IgG, a polyclonal antibody, a labeled antibody, a humanized antibody, a human antibody, and fragments thereof.

In another embodiment, the antibody of the present invention further comprises a human or humanized VH framework and a human or humanized VL framework. In some embodiments, the VH framework comprises a sequence of SEQ ID NO: 5, 6, 7, 8, 15, 16, 17, 18, 23, 24, 25, 30, 31, 32, 37, 38, 39, 40, 45, 46, 47, 49, 50, 51, 54, 55, 56, 58, 59, 61, or 63; and/or the VL framework comprises a sequence of SEQ ID NO: 80, 81, 82, 83, 86, 87, 88, 89, 96, 97, 98, 99, 103, 110, 111, 116, 117, 118, 122, 123, 124, 126, 127, 128, 130, 131, 132, 133, 135, 139, or 155.

In another embodiment, the invention provides an isolated human monoclonal antibody that binds to an epitope on GUCY2c extracellular domain, wherein the epitope comprises at least one amino acid residue selected from amino acid residues R73, S74, S75, T76, E78, G79, L80, L82, L83, R84 or I86 of SEQ ID NO: 406.

In one aspect, the epitope comprises at least two, at least three, at least four, at least five, at least six, at least seven, at least eight, at least nine, or at least ten amino acid residues selected from amino acid residues R73, S74, S75, T76, E78, G79, L80, L82, L83, R84 or I86 of SEQ ID NO: 406. In another aspect, the epitope comprises the amino acid residues R73, S74, S75, T76, E78, G79, L80, L82, L83, R84 or I86 of SEQ ID NO: 406. In a further aspect, the epitope comprises amino acids having a sequence as set forth in SEQ ID NO: 406. In a further aspect, the epitope is a functional epitope.

In another aspect, the isolated human antibody and the GUCY2c epitope amino acid contacts are within 3.8 Angstroms as determined by crystallography. As used herein "within 3.8 Angstroms" means the contacts are less than or equal to 3.8 Angstroms.

In one aspect, the antibody of the present invention is a bispecific antibody. In another aspect, the invention provides a bispecific antibody that specifically binds to GUCY2c and CD3, wherein the bispecific antibody comprises a first polypeptide chain and a second polypeptide chain.

In one embodiment, (a) the first polypeptide chain comprises, in the N-terminal to C-terminal direction: (i) a Domain 1, comprising a VL of a GUCY2c antibody (GUCY2c VL), and a VH of a CD3 antibody (CD3 VH), and (ii) a first heterodimer-promoting domain; and (b) the second polypeptide chain comprises, in the N-terminal to C-terminal direction: (i) a Domain 2, comprising a VL of a CD3 antibody (CD3 VL), and a VH of a GUCY2c antibody (GUCY2c VH), and (ii) a second heterodimer-promoting domain; wherein the GUCY2c VL and the GUCY2c VH form a domain that specifically binds to GUCY2c; and the CD3 VL and the CD3 VH form a domain that specifically binds to CD3.

In another embodiment, (a) the first polypeptide chain comprises, in the N-terminal to C-terminal direction: (i) a Domain 1, comprising a CD3 VL, and a GUCY2c VH, and (ii) a first heterodimer-promoting domain; and (b) the second polypeptide chain comprises, in the N-terminal to C-terminal direction: (i) a Domain 2 comprising a GUCY2c VL, and a CD3 VH, and (ii) a second heterodimer-promoting domain; wherein the GUCY2c VL and the GUCY2c VH form a domain that specifically binds to GUCY2c; and the CD3 VL and the CD3 VH form a domain that specifically binds to CD3.

In another embodiment, (a) the first polypeptide chain comprises, in the N-terminal to C-terminal direction: (i) a Domain 1, comprising a GUCY2c VH, and a CD3 VL, and (ii) a first heterodimer-promoting domain; and (b) the second polypeptide chain comprises, in the N-terminal to C-terminal direction: (i) a Domain 2, comprising a CD3 VH, and a GUCY2c VL, and (ii) a second heterodimer-promoting domain; wherein the GUCY2c VH and the GUCY2c VL form a domain that specifically binds to GUCY2c; and the CD3 VH and the CD3 VL form a domain that specifically binds to CD3.

In a further embodiment, (a) the first polypeptide chain comprises, in the N-terminal to C-terminal direction: (i) a Domain 1, comprising a CD3 VH, and a GUCY2c VL, and (ii) a first heterodimer-promoting domain; and (b) the second polypeptide chain comprises, in the N-terminal to C-terminal direction: (i) a Domain 2, comprising a GUCY2c VH, and a CD3 VL, and (ii) a second heterodimer-promoting domain, wherein the GUCY2c VL and the GUCY2c VH form a domain that specifically binds to GUCY2c; and the CD3 VL and the CD3 VH form a domain that specifically binds to CD3.

In some embodiments of the each of the foregoing, the first heterodimer-promoting domain and the second heterodimer-promoting domain each comprise a CH2 domain and a CH3 domain, wherein the amino acid sequence of each of the CH2 domain and/or the CH3 domain is modified to drive heterodimerization and/or stabilize the bispecific antibody.

In some such embodiments, the amino acid sequence of the CH2 domain and/or the CH3 domain comprises at least one amino acid modification, wherein: (a) the CH3 domain of the first heterodimer-promoting domain forms a knob; and (b) the CH3 domain of the second heterodimer-promoting domain forms a hole.

In another such embodiment, the CH3 domain of the first heterodimer-promoting domain comprises mutations Y349C and/or T366W; and the CH3 domain of the second heterodimer-promoting domain comprises mutations S354C, T366S, L368A, and/or Y407V, (numbering according to the EU index).

In a particular embodiment of each of the foregoing, the first heterodimer-promoting domain comprises a sequence of SEQ ID NO: 188; wherein the second heterodimer-promoting domain comprises a sequence of SEQ ID NO: 189.

In additional embodiments, the GUCY2c VL and the CD3 VH are linked by a glycine-serine linker; and the CD3 VL and the GUCY2c VH are linked by a glycine-serine linker. In some such embodiments, the glycine-serine linker is Linker 1 comprising a sequence of SEQ ID NO: 190. In other embodiments, the glycine-serine linker is Linker 2 comprising a sequence of SEQ ID NO: 191.

In further embodiments of each of the foregoing, Domain 1 is covalently bound to the first heterodimer-promoting domain via a cysteine linker; and Domain 2 is covalently bound to the second heterodimer-promoting domain via a cysteine linker; wherein the cysteine linker comprises at least five amino acids. In some such embodiments, the cysteine linker is Linker 3 comprising a sequence of SEQ ID NO: 192.

In some embodiments, the first polypeptide chain is covalently bound to the second polypeptide chain by at least one disulfide bond. In some such embodiments, at least one disulfide bond forms between Linker 3 of the first polypeptide chain and Linker 3 of the second polypeptide chain. In another such embodiment, at least one disulfide bond is formed between the first heterodimer-promoting domain and the second heterodimer-promoting domain. In specific embodiments, each disulfide bond is formed by linking two cysteine residues.

In further embodiments of any of the foregoing, the bispecific antibody of the present invention comprises (a) a GUCY2c VH CDR1 comprising a sequence of SEQ ID NO: 12, 20, 27, 34, 42, 74, 257, 258, 259, 260, or 261; (b) a GUCY2c VH CDR2 comprising a sequence of SEQ ID NO: 13, 21, 28, 35, 43, 53, 66, 68, 70, 72, 75, 262, 263, 264, 265, 266, or 267; (c) a GUCY2c VH CDR3 comprising a sequence of SEQ ID NO: 14, 22, 29, 36, or 44; (d) a GUCY2c VL CDR1 comprising a sequence of SEQ ID NO: 93, 101, 105, 107, 113, 120, 148, 153, 163, or 167; (e) a GUCY2c VL CDR2 comprising a sequence of SEQ ID NO: 78, 94, 102, 108, 114, 141, 144, 146, 149, 151, 157, 159, 161, 164, or 168; and (f) a GUCY2c VL CDR3 comprising a sequence of SEQ ID NO: 95, 109, 115, 121, 142, 154, 165, or 169.

In a particular embodiment, the bispecific antibody of the present invention comprises (a) a GUCY2c VH CDR1 comprising a sequence of SEQ ID NO: 74, or 259; (b) a GUCY2c VH CDR2 comprising a sequence of SEQ ID NO: 75, or 267; (c) a GUCY2c VH CDR3 comprising a sequence of SEQ ID NO: 29; (d) a GUCY2c VL CDR1 comprising a sequence of SEQ ID NO: 148; (e) a GUCY2c VL CDR2 comprising the sequence of SEQ ID NO: 149; and (f) a GUCY2c VL CDR3 comprising a sequence of SEQ ID NO: 142.

In specific embodiments, the bispecific antibody comprises: (a) a GUCY2c VH region comprising a sequence of SEQ ID NO: 73; and (b) a GUCY2c VL region comprising the sequence shown in SEQ ID NO: 147.

In additional embodiments, the invention provides bispecific antibodies comprising (a) a CD3 VH CDR1 comprising a sequence of SEQ ID NO: 2, 268, or 277; (b) a CD3 VH CDR2 comprising a sequence of SEQ ID NO: 3, 10, 269, or 270; (c) a CD3 VH CDR3 comprising a sequence of SEQ ID NO: 4; (d) a CD3 VL CDR1 comprising a sequence of SEQ ID NO: 77, 85, 91, 278, 279, or 280; (e) a CD3 VL CDR2 comprising the SEQ ID NO: 78, or 281; and (f) a CD3 VL CDR3 comprising a sequence of SEQ ID NO: 79.

In a particular embodiment, the invention provides a bispecific antibody comprising (a) a CD3 VH CDR1 comprising the sequence of SEQ ID NO: 2, or 268; (b) a CD3 VH CDR2 comprising the sequence of SEQ ID NO: 10, or 270; (c) a CD3 VH CDR3 comprising the sequence of SEQ ID NO: 4; (d) a CD3 VL CDR1 comprising the sequence of SEQ ID NO: 91; (e) a CD3 VL CDR2 comprising the sequence of SEQ ID NO: 78; and (f) a CD3 VL CDR3 comprising the sequence of SEQ ID NO: 79.

In one embodiment, the invention provides a bispecific antibody comprising: (a) a CD3 VH region comprising the sequence of SEQ ID NO: 1, 9, or 273; and (b) a CD3 VL region comprising the sequence of SEQ ID NO: 76, 84, 90, 274, 275, or 276. In a particular embodiment, the bispecific antibody of the present invention comprises: (a) a CD3 VH region comprising the sequence of SEQ ID NO: 9; and (b) a CD3 VL region comprising the sequence of SEQ ID NO: 90.

In another embodiment, the invention provides a bispecific antibody that binds to an epitope on GUCY2c extracellular domain, wherein the epitope comprises at least one amino acid residue selected from amino acid residues R73, S74, S75, T76, E78, G79, L80, L82, L83, R84 or I86 of SEQ ID NO: 406.

In one aspect, the epitope comprises at least two, at least three, at least four, at least five, at least six, at least seven, at least eight, at least nine, or at least ten amino acid residues selected from amino acid residues R73, S74, S75, T76, E78, G79, L80, L82, L83, R84 or I86 of SEQ ID NO: 406. In another aspect, the epitope comprises the amino acid residues R73, S74, S75, T76, E78, G79, L80, L82, L83, R84 or I86 of SEQ ID NO: 406. In a further aspect, the epitope comprises amino acids having a sequence as set forth in SEQ ID NO: 406. In a further aspect, the epitope is a functional epitope.

In another aspect, the isolated human antibody and the GUCY2c epitope amino acid contacts are within 3.8 Angstroms as determined by crystallography.

In one aspect, the invention provides a bispecific antibody that specifically binds to GUCY2c and competes for binding with the bispecific antibody as disclosed herein.

In one aspect, the invention provides a bispecific antibody that specifically binds to GUCY2c and CD3, wherein the bispecific antibody comprises a first polypeptide chain and a second polypeptide chain, and wherein: (a) the first polypeptide chain comprises the following regions in the following order in an N-terminal to C-terminal direction: a VL of a GUCY2c antibody (GUCY2c VL) (SEQ ID NO: 147)—Linker 1 (SEQ ID NO: 190)—a VH of a CD3 antibody (CD3 VH) (SEQ ID NO: 9)—Linker 3 (SEQ ID NO: 192)—a first heterodimer-promoting domain (SEQ ID NO: 188); and (b) the second polypeptide chain comprises the following regions in the following order in an N-terminal to C-terminal direction: a VL of a CD3 antibody (CD3 VL) (SEQ ID NO: 90)—Linker 2 (SEQ ID NO: 191)—a VH of a GUCY2c antibody (GUCY2c VH) (SEQ ID NO: 73)—Linker 3 (SEQ ID NO: 192)—a second heterodimer-promoting domain (SEQ ID NO: 189); wherein the GUCY2c VL and the GUCY2c VH form a domain that specifically binds to GUCY2c; and the CD3 VL and the CD3 VH form a domain that specifically binds to CD3; wherein Linker 3 of the first polypeptide chain and Linker 3 of the second polypeptide chain are covalently bound to one another by two disulfide bonds; wherein the first heterodimer-promoting domain and the second heterodimer-promoting domain each comprise a CH2 domain and a CH3 domain; wherein the CH3 domain of the first heterodimer-promoting domain forms a knob, and the CH3 domain of the second heterodimer-promoting domain forms a hole; wherein at least one disulfide bond is formed between the CH3 domain of the first heterodimer-promoting domain and the CH3 domain of the second heterodimer-promoting domain.

In some embodiments, the invention provides a bispecific antibody further comprising a human or humanized VH framework, and a human or humanized VL framework. In some such embodiments, the bispecific antibody is a humanized antibody. In specific embodiments, the VH framework comprises a sequence of SEQ ID NO: 5, 6, 7, 8, 15, 16, 17, 18, 23, 24, 25, 30, 31, 32, 37, 38, 39, 40, 45, 46, 47, 49, 50, 51, 54, 55, 56, 58, 59, 61, or 63; and/or the VL framework comprises a sequence of SEQ ID NO: 80, 81, 82, 83, 86, 87, 88, 89, 96, 97, 98, 99, 103, 110, 111, 116, 117, 118, 122, 123, 124, 126, 127, 128, 130, 131, 132, 133, 135, 139, or 155.

In one aspect, the bispecific antibody of the present invention specifically binds to GUCY2c and CD3, wherein the bispecific antibody comprises a first polypeptide chain and a second polypeptide chain; wherein the first polypeptide chain is produced by the expression vector with ATCC Accession No. PTA-124944; and the second polypeptide chain is produced by the expression vector with ATCC Accession No. PTA-124943.

In particular embodiments, the antibody or the bispecific antibody of the present invention (a) binds to the extracellular domain of human GUCY2c; (b) demonstrates an extended serum and tumor half-life of between 30 min to 100 days; and/or (c) demonstrates a lower ECK value of between 0.0001 nM and 100 nM in the presence of increased GUCY2c expression levels or increased receptor density levels.

The present invention further provides a pharmaceutical composition comprising a therapeutically effective amount of an antibody or a bispecific antibody disclosed herein, and a pharmaceutically acceptable carrier.

In another aspect, the present invention provides a method of treating a GUCY2c associated disorder in a patient in need thereof, comprising administering to the patient a GUCY2c antibody of the present invention. The present invention also provides a method of treating a GUCY2c associated disorder in a patient in need thereof, comprising administering to the patient a bispecific antibody of the present invention. The present invention further provides a method of treating a GUCY2c associated disorder in a patient in need thereof, comprising administering to the patient a pharmaceutical composition comprising a GUCY2c antibody or a bispecific antibody disclosed herein. In some such embodiments, the GUCY2c associated disorder is cancer. In specific embodiments, the cancer is a cancer of digestive system selected from the group consisting of esophagus, stomach, small intestine, colon, rectum, anus, liver, gall bladder, appendix, bile ducts, and pancreas.

The present invention further provides a method of treating a GUCY2c associated disorder in a patient in need thereof, comprising administering to the patient a bispecific antibody as disclosed herein, or a pharmaceutical composition comprising a bispecific antibody as disclosed herein, wherein a cytolytic T cell response is activated.

In one aspect, the present invention provides an antibody, a bispecific antibody, or a pharmaceutical composition as disclosed herein for use in therapy. The present invention further provides an antibody, or a bispecific antibody as disclosed herein for use in the manufacture of a medicament for use in therapy. In some embodiments, the therapy is a treatment of a GUCY2c associated disorder. In specific embodiments, the GUCY2c associated disorder is cancer. In some embodiments, the cancer is a cancer of digestive system selected from the group consisting of esophagus, stomach, small intestine, colon, rectum, anus, liver, gall bladder, appendix, bile ducts, and pancreas. In specific embodiments, the therapy activates a cytolytic T cell response.

In one aspect, the present invention provides a polynucleotide that encodes an antibody or a bispecific antibody as disclosed herein. In another embodiment, the invention provides a vector comprising polynucleotides as disclosed herein. In yet another embodiment, the invention provides a host cell comprising the vectors as disclosed herein. In some such embodiments, the host cell recombinantly produces the antibody or the bispecific antibody as disclosed herein. In specific embodiments, the host cell is selected from the group consisting of bacterial cell lines, mammalian cell lines, insect cell lines and yeast cell lines. In a particular embodiment, the mammalian cell line is a CHO cell line. In one embodiment, the antibody or the bispecific antibody is produced using an in vitro cell free protein synthesis system.

In one aspect, the present invention provides a method of producing a GUCY2c antibody or a bispecific antibody as disclosed herein, comprising culturing a host cell, under conditions that results in production of a GUCY2c antibody or a bispecific antibody as disclosed herein, and purifying the antibody or the bispecific antibody from the culture supernatant.

In another aspect, the present invention provides a use of a GUCY2c antibody, a bispecific antibody, a pharmaceutical composition, a polynucleotide, a vector, or a host cell as disclosed herein, in the manufacture of a medicament for treating a GUCY2c associated disorder.

In another embodiment, the present invention provides a composition comprising the bispecific antibodies of the invention and a second therapeutic agent.

In another embodiment, the present invention provides a composition comprising the bispecific antibodies of the invention and an antidiarrheal agent.

In one aspect, the antidiarrheal agent includes, but is not limited to, bismuth subgallate, *Lactobacillus acidophilus*, *Saccharomyces boulardii*, loperamide/simethicone, atropine/diphenoxylate, atropine/difenoxin, *Saccharomyces boulardii* lyo, *Lactobacillus acidophilus*, loperamide, bismuth subsalicylate, *Lactobacillus acidophilus/Lactobacillus*

*bulgaricus, Lactobacillus rhamnosus*, attapulgite, crofelemer, fluoroquinolone, antibiotic or octreotide.

In another aspect, the present invention provides use of a composition comprising a GUCY2c bispecific antibody and an antidiarrheal agent as disclosed herein, in the manufacture of a medicament for treating a GUCY2c associated disorder.

Other embodiments will become apparent from a review of the detailed description. Where aspects or embodiments of the invention are described in terms of a Markush group or other grouping of alternatives, the present invention encompasses not only the entire group listed as a whole, but also each member of the group individually so and all possible subgroups of the main group, and also the main group absent one or more of the group members. The present invention also envisages the explicit exclusion of one or more of any of the group members in the claimed invention.

BRIEF DESCRIPTION OF FIGURES/DRAWINGS

Figure 4A:
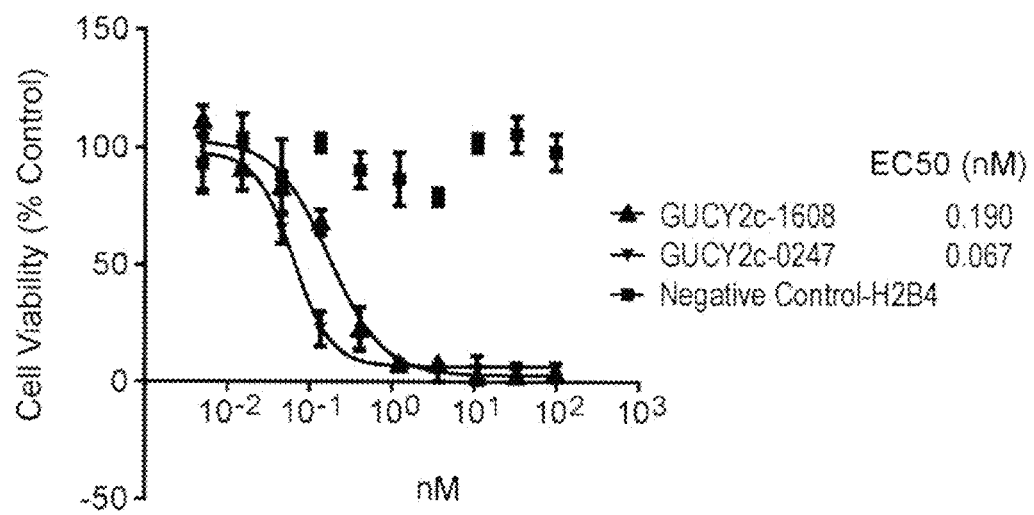
Figure 4B:
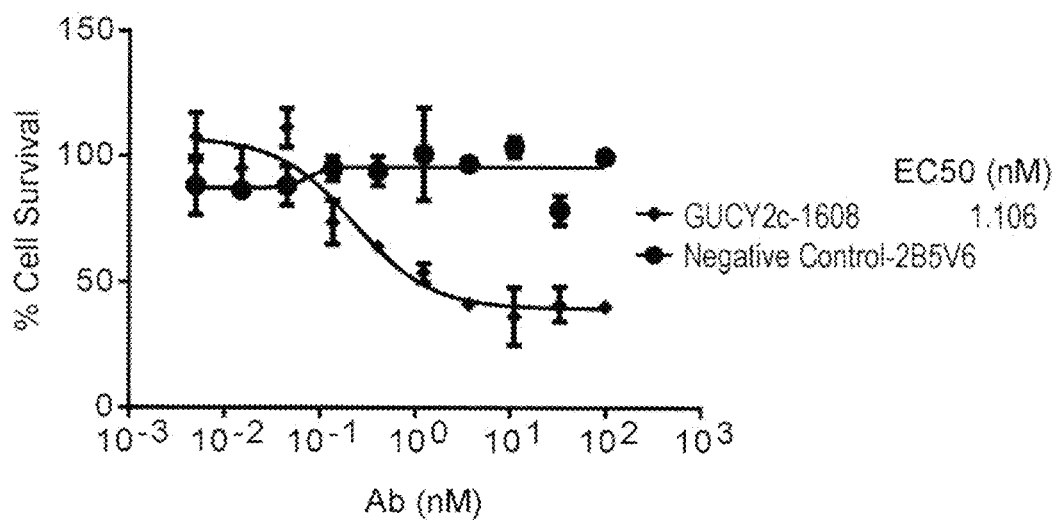
Figure 4C:
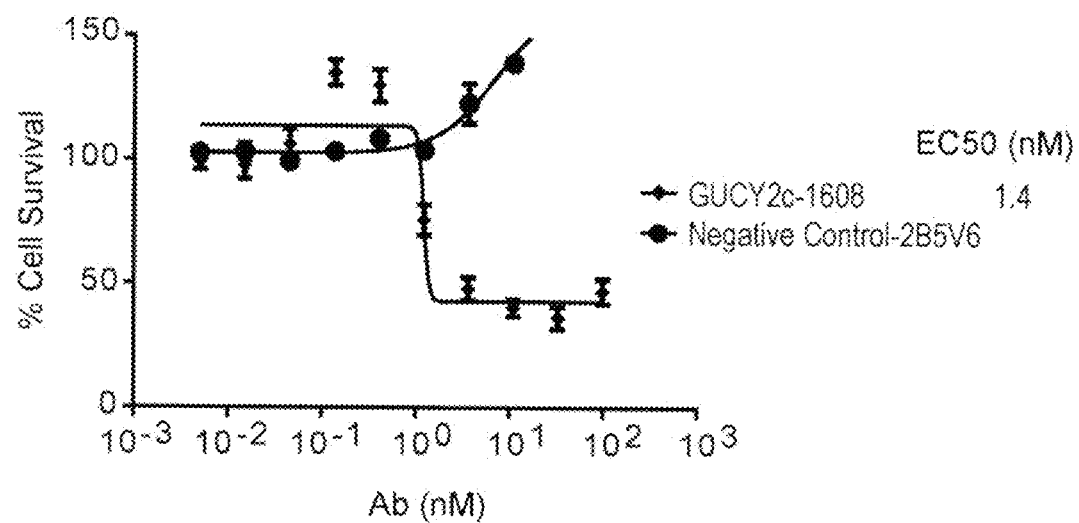
Figure 4D:
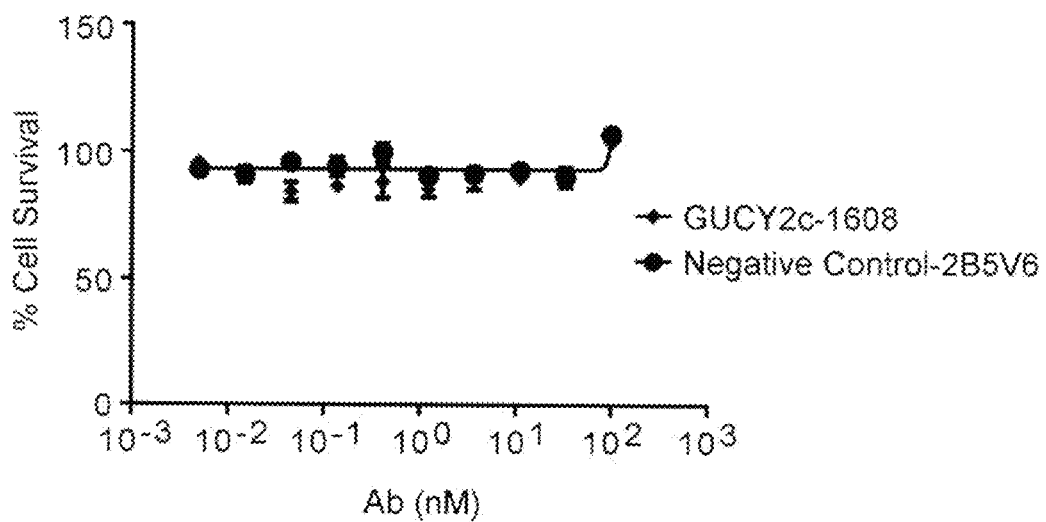

FIG. 4A depicts GUCY2C-1608 and GUCY2C-0247 recruiting naïve human T cells to induce cell killing in T84 tumors cells. FIG. 4B depicts GUCY2C-1608 mediated cytotoxic T cell activity seen in GUCY2c expressing tumor cell lines, LS1034. FIG. 4C depicts GUCY2C-1608 mediated cytotoxic T cell activity is seen in GUCY2c expressing tumor cell lines, LS174T. FIG. 4D depicts that no activity is observed with GUCY2C-1608 in GUCY2c-negative cell line.

Figure 5B:
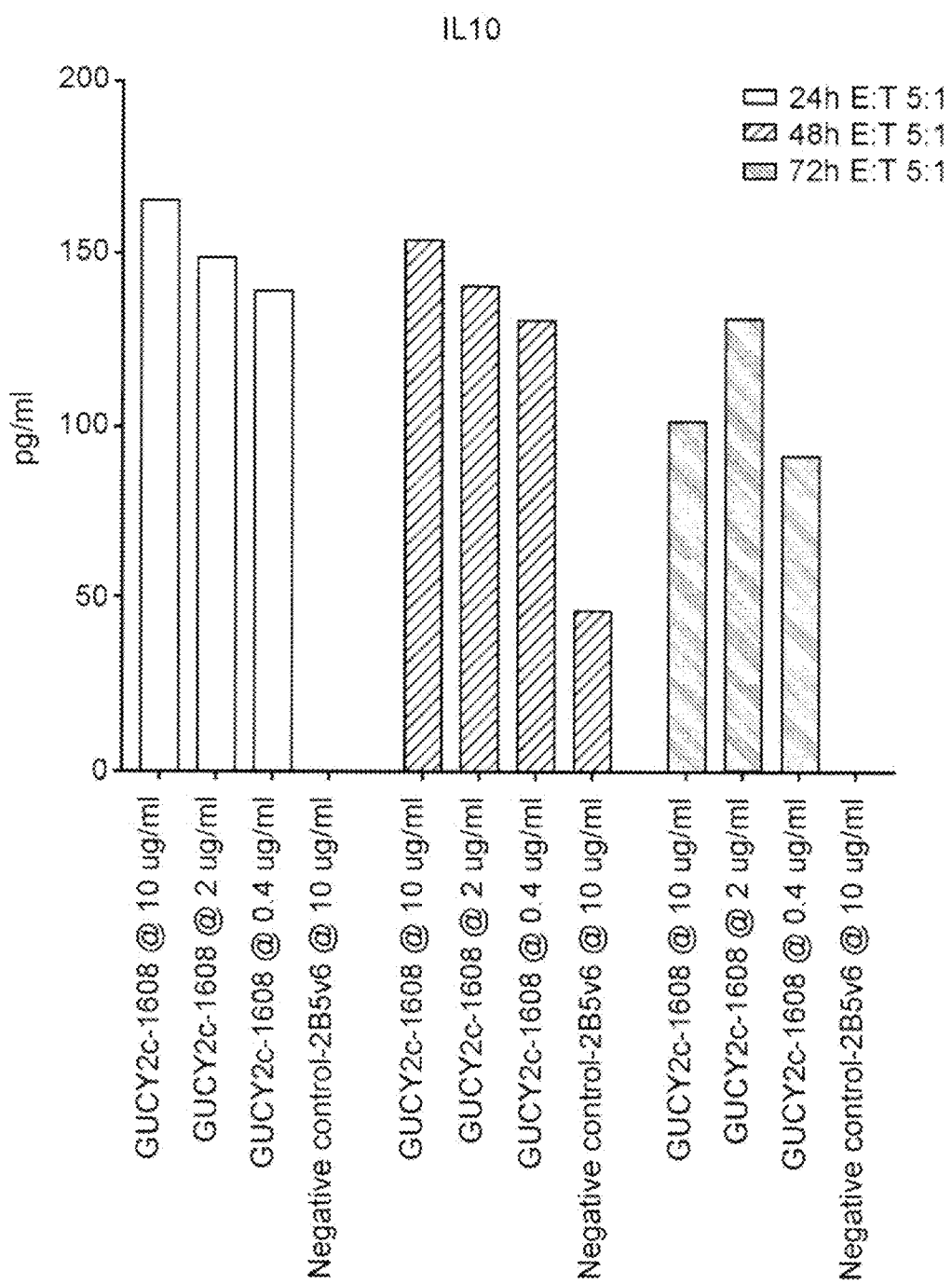
Figure 5D:
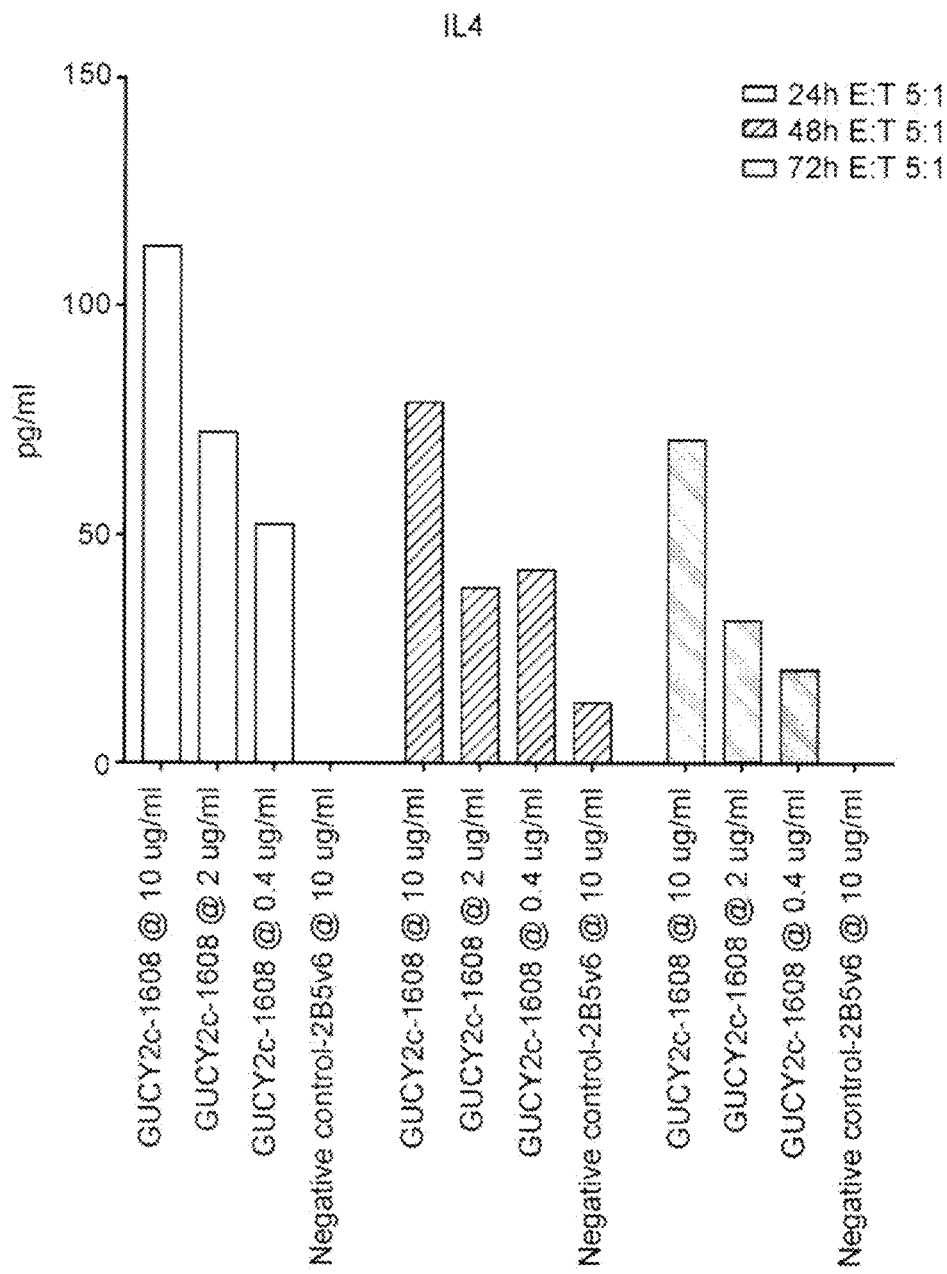
Figure 5E:
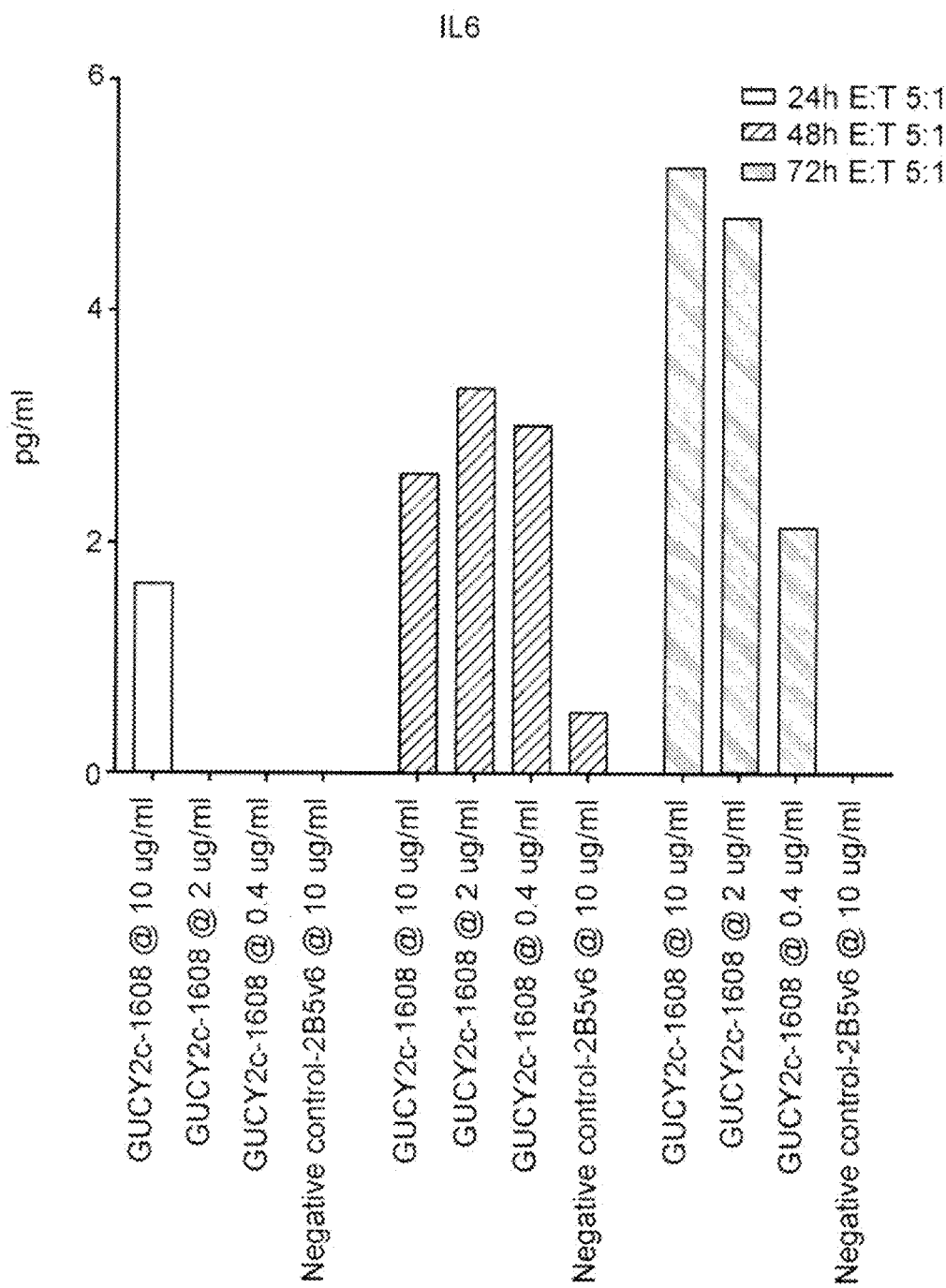
Figure 5F:
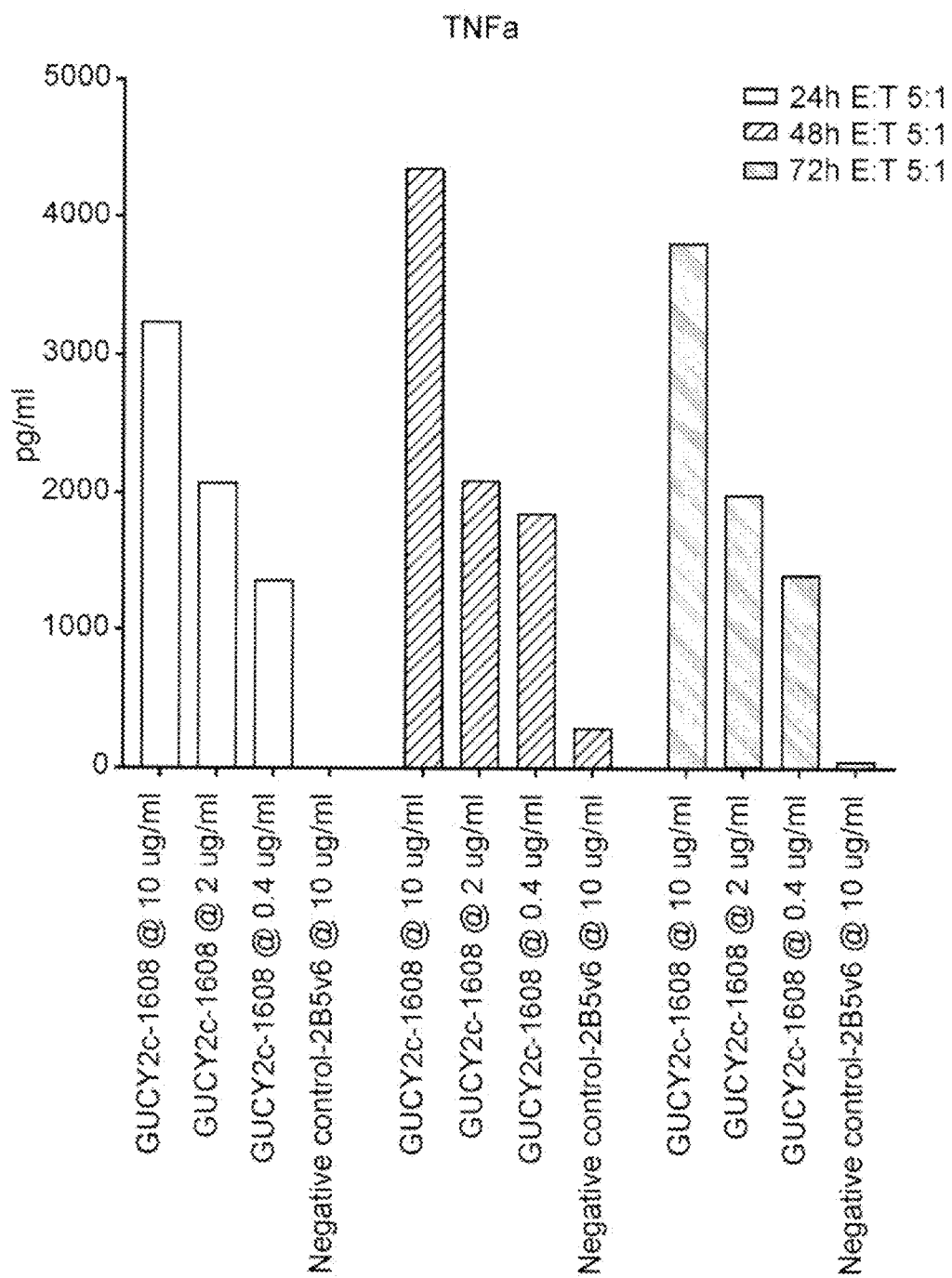

FIGS. 5A to 5F depict in vitro analysis of cytokine release induced upon GUCY2C-1608 mediated recruitment of naïve human T cells to GUCY2c-expressing T84 cells. Luminex based assay showed upregulation of human IFN-gamma (FIG. 5A), IL10 (FIG. 5B), IL2 (FIG. 5C), IL4 (FIG. 5D), IL6 (FIG. 5E), and TNF-alpha (FIG. 5F).

FIG. 6 depicts dose dependent tumor growth inhibition by GUCY2C-0247 in T84 colorectal carcinoma cell line xenograft tumors in an adoptive transfer model.

FIG. 7 depicts dose dependent tumor growth inhibition by GUCY2C-0247 in HT55 colorectal carcinoma cell line xenograft tumors in an adoptive transfer model.

Figure 8:
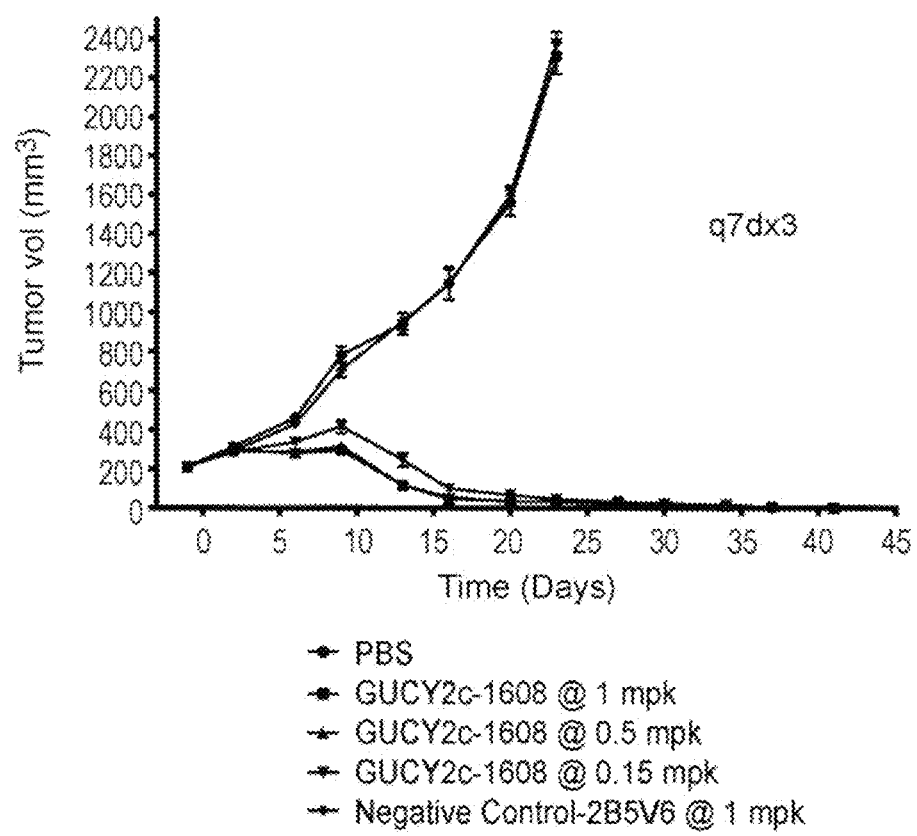

FIG. 8 depicts dose dependent tumor growth inhibition by GUCY2C-1608 in HT55 colorectal carcinoma cell line xenograft tumors in an adoptive transfer model.

Figure 9:
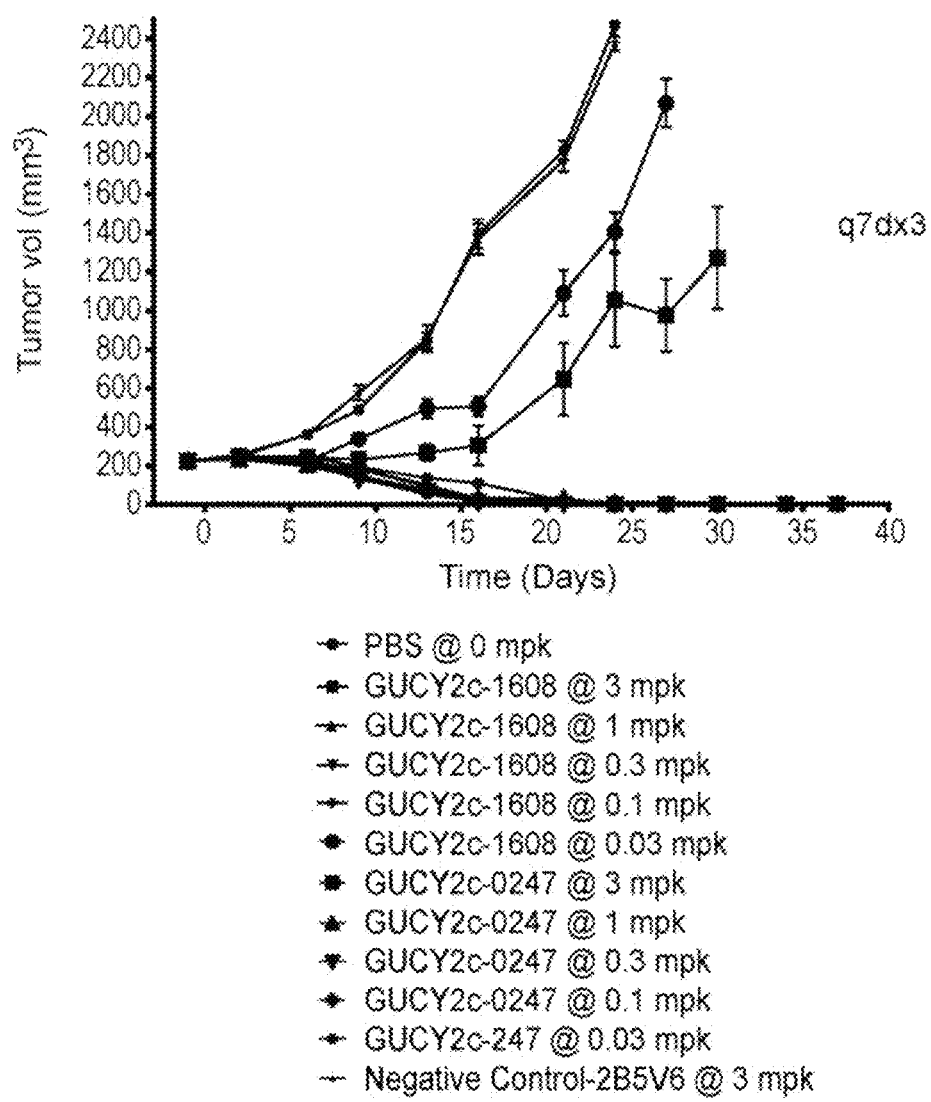

FIG. 9 depicts dose dependent tumor growth inhibition by GUCY2c bispecific antibodies, GUCY2C-0247 and GUCY2C-1608, in colorectal cancer LS1034 cell line xenograft-tumors in an adoptive transfer model.

Figure 10:
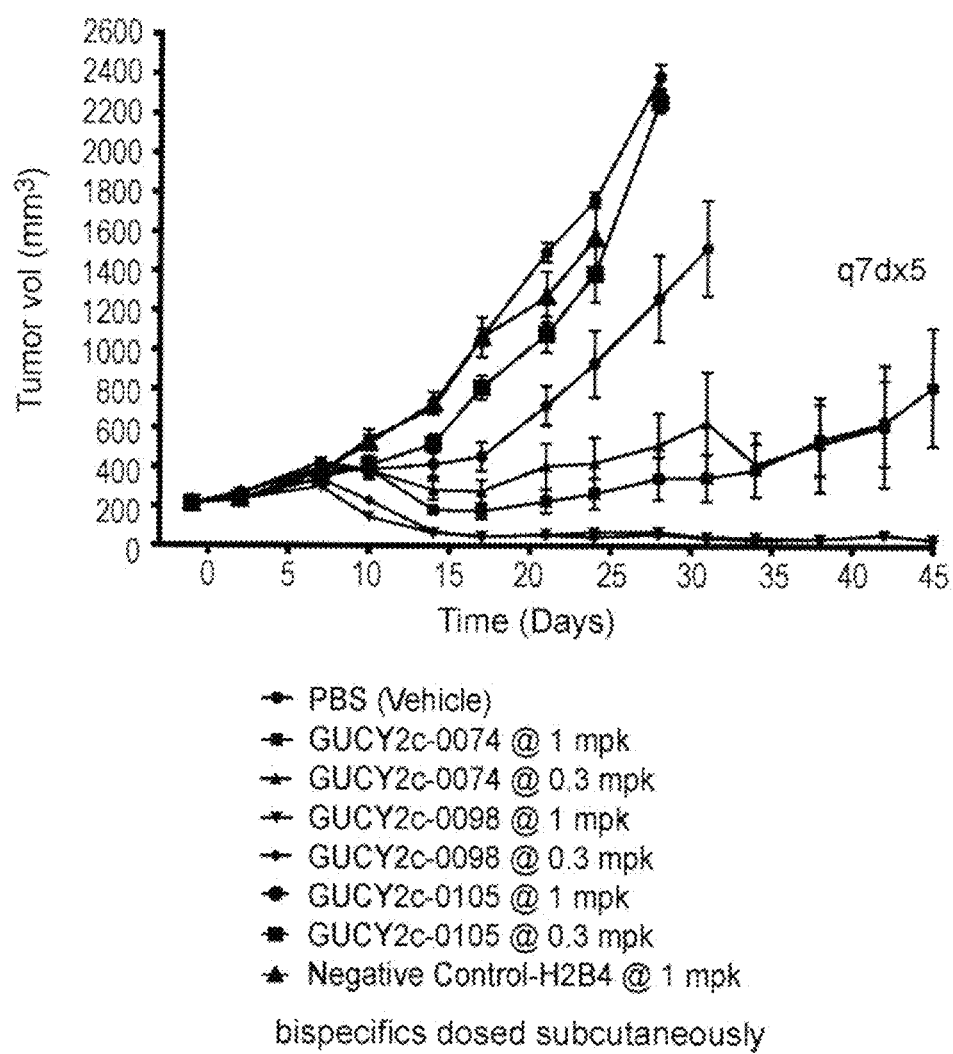

FIG. 10 depicts tumor growth inhibition by GUCY2c bispecific antibodies, GUCY2C-0074, GUCY2C-0098 and GUCY2C-0105, in colorectal cancer LS1034 cell line xenograft—tumors in an adoptive transfer model tumor growth inhibition by GUCY2c bispecific antibodies, GUCY2C-0074, GUCY2C-0098 and GUCY2C-0105, in colorectal cancer LS1034 cell line xenograft-tumors in an adoptive transfer model.

Figure 11:
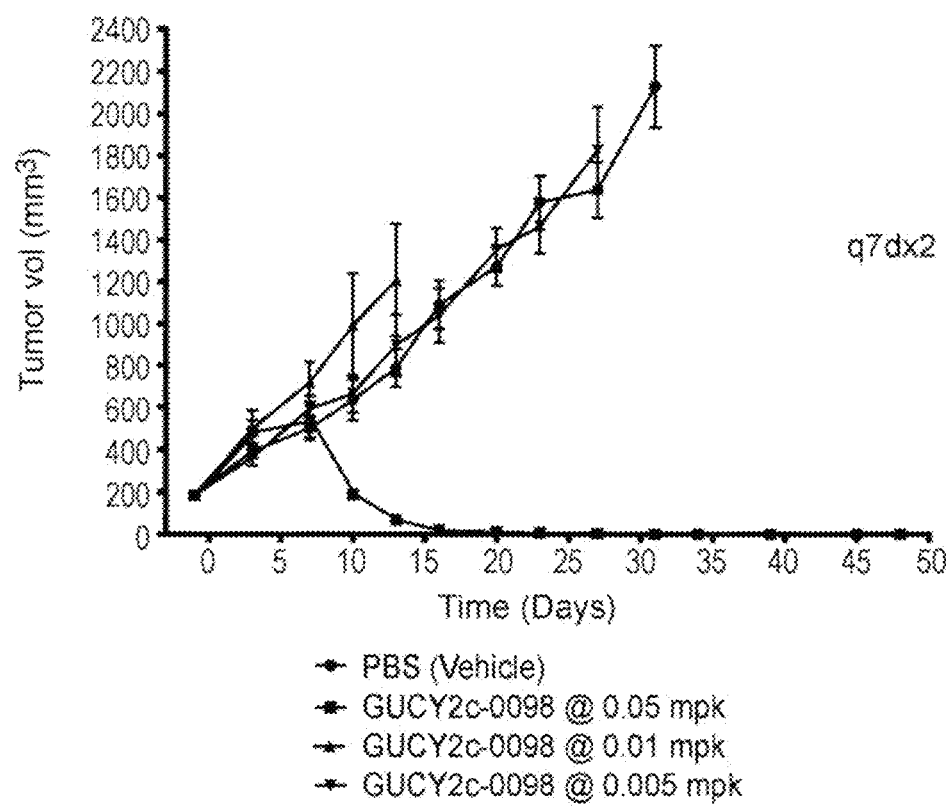

FIG. 11 depicts dose dependent tumor growth inhibition by GUCY2C-0098 in PDX-CRX-11201 colorectal carcinoma patient derived xenograft tumors in an adoptive transfer model.

Figure 12:
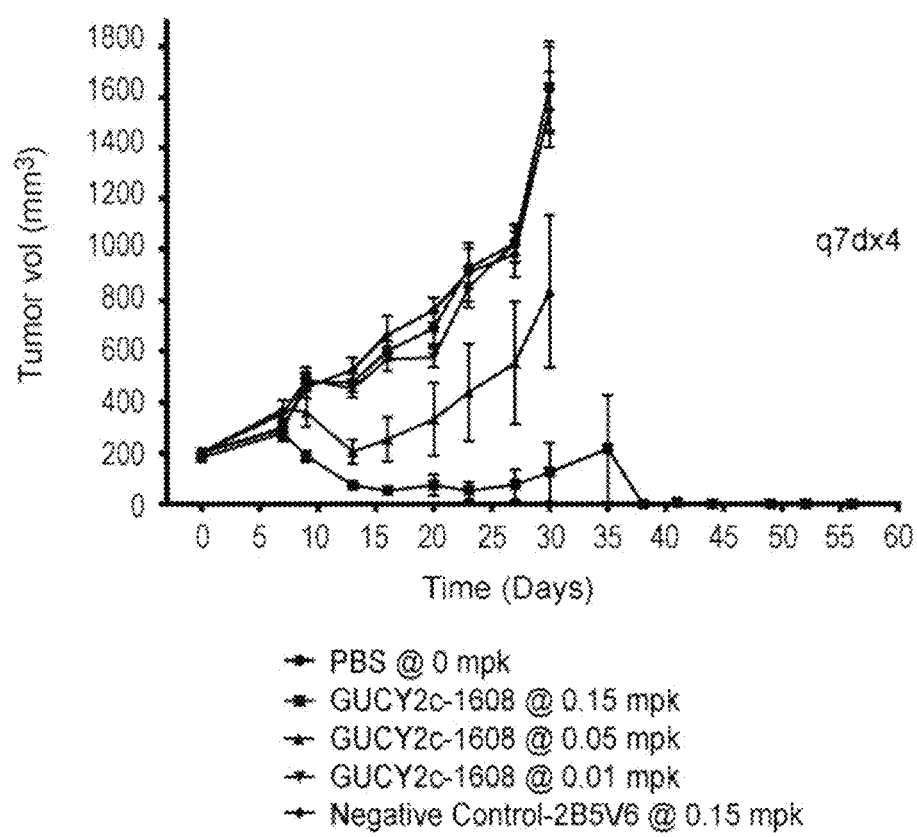

FIG. 12 depicts dose dependent tumor growth inhibition by GUCY2C-1608 in PDX-CRX-11201 colorectal carcinoma patient derived xenograft tumors in an adoptive transfer model.

Figure 13:
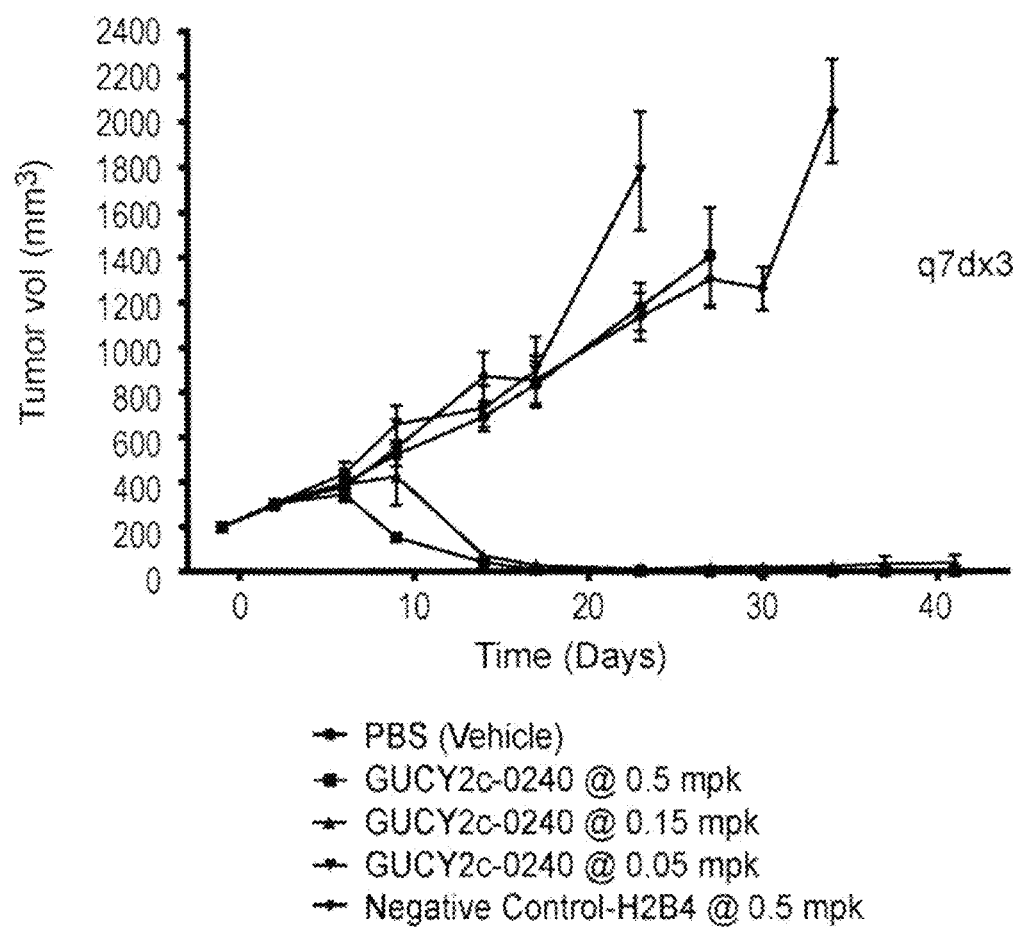

FIG. 13 depicts tumor growth inhibition by GUCY2C-0240 in PDX-CRX-11201 colorectal carcinoma patient derived xenograft tumors in an adoptive transfer model.

Figure 14:
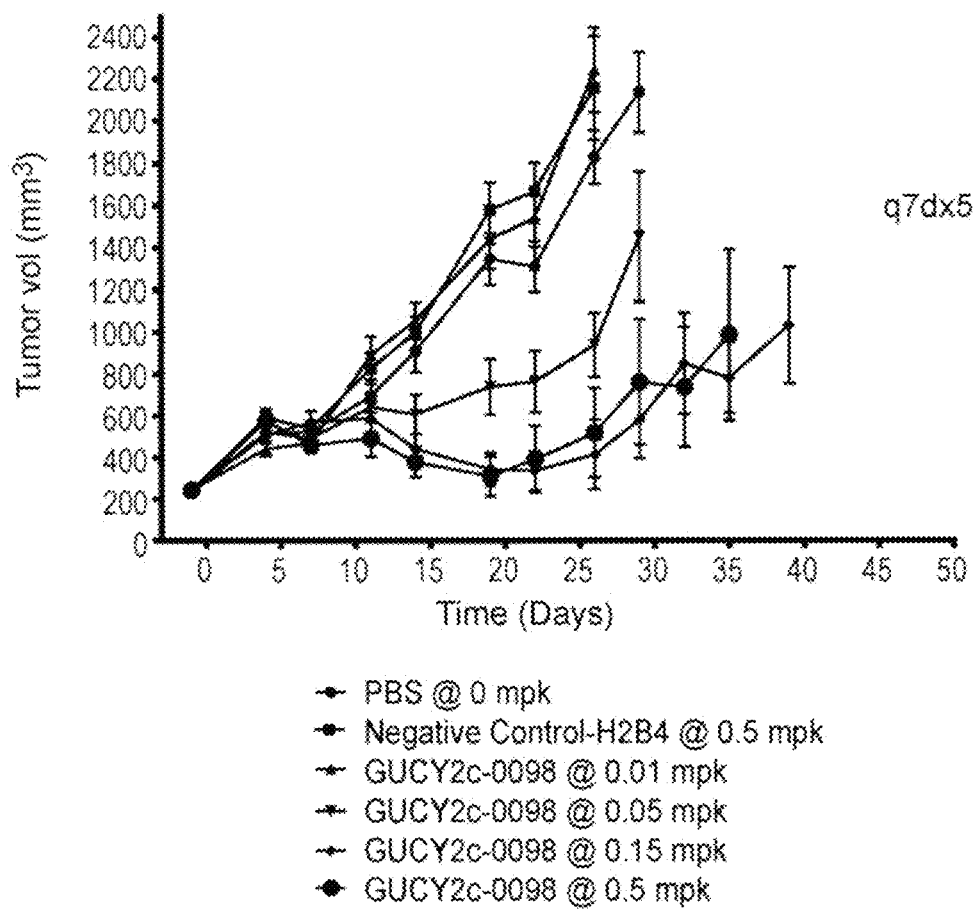

FIG. 14 depicts tumor growth inhibition by GUCY2C-0098 tumor growth inhibition in PDX-CRX-12213 colorectal carcinoma patient derived xenograft tumors in an adoptive transfer model.

Figure 15:
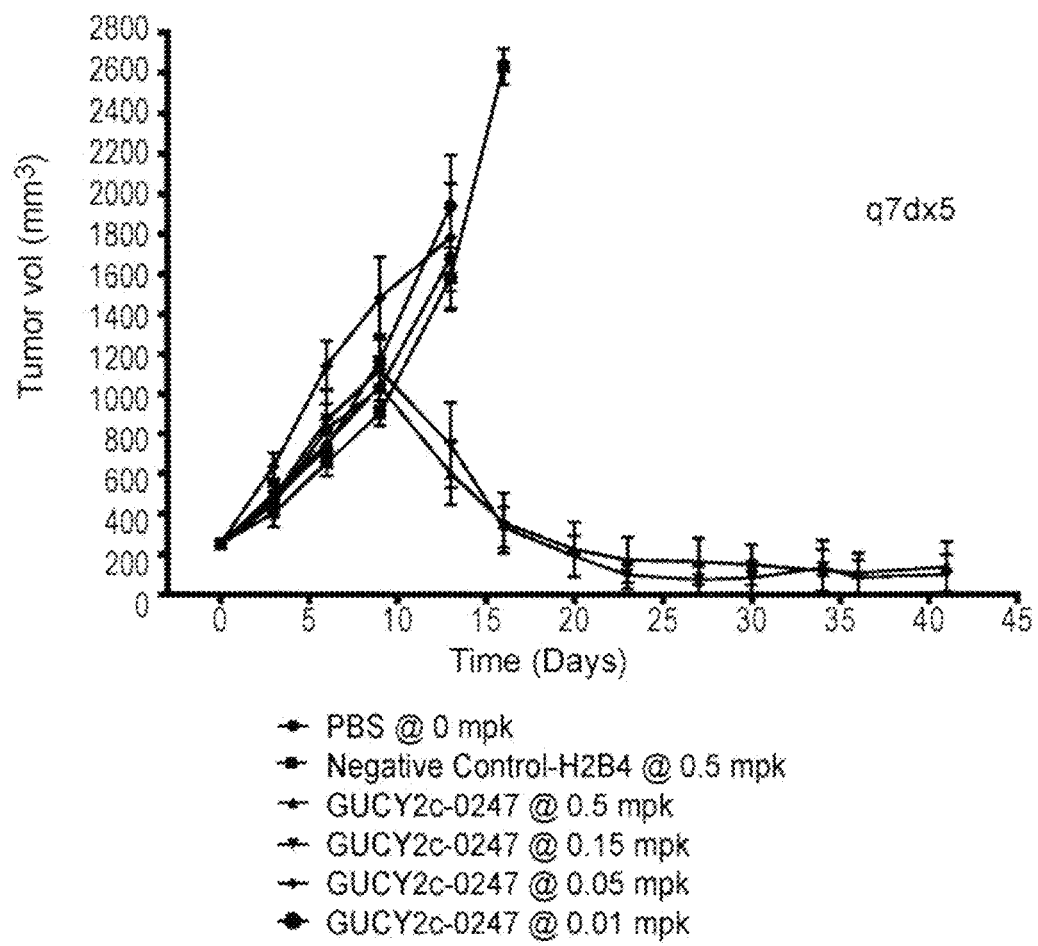

FIG. 15 depicts tumor growth inhibition by GUCY2C-0247 in PDX-CRX-24225 colorectal carcinoma patient derived xenograft tumors in an adoptive transfer model.

Figure 16:
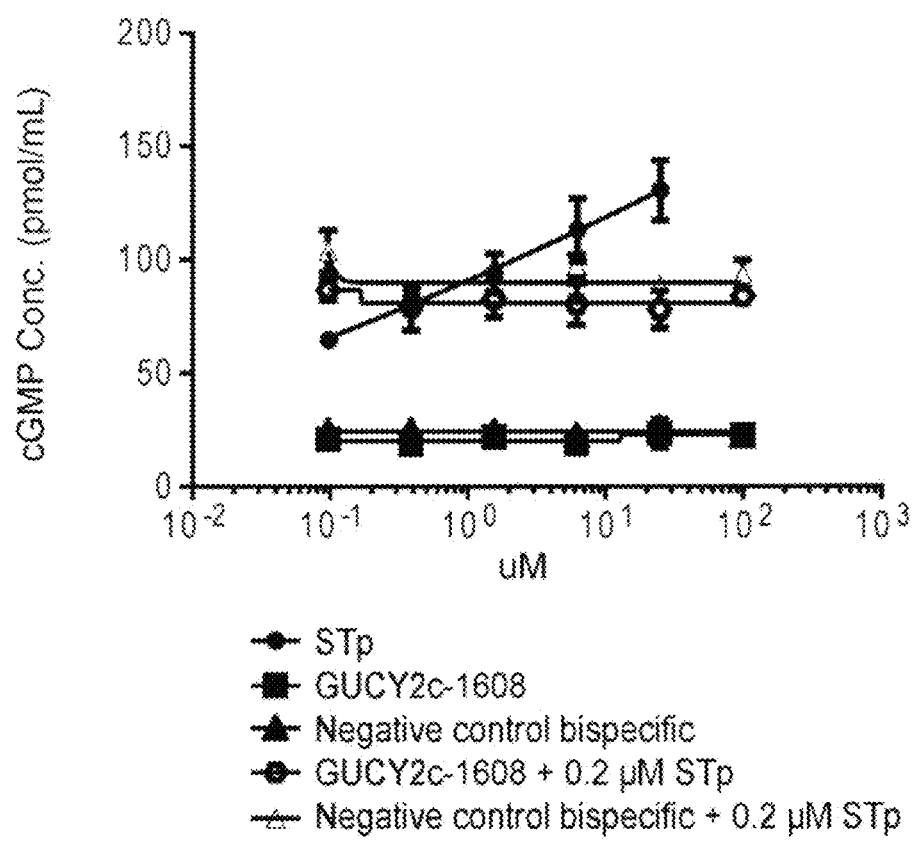

FIG. 16 depicts the characterization of cGMP induction and neutralization ability of GUCY2c-CD3 bispecific in T84 cells.

Figure 17:
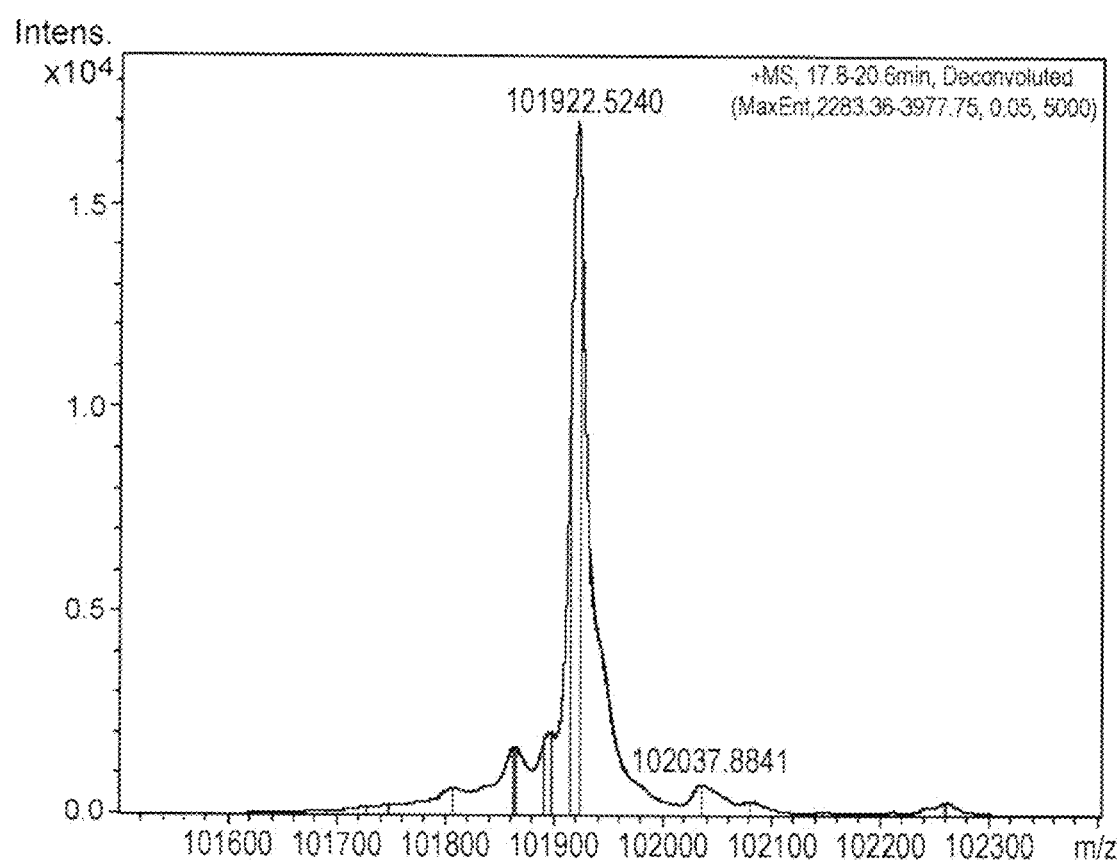

FIG. 17 depicts the LC/MS analysis of GUCY2C-1608 following purification.

Figure 18:
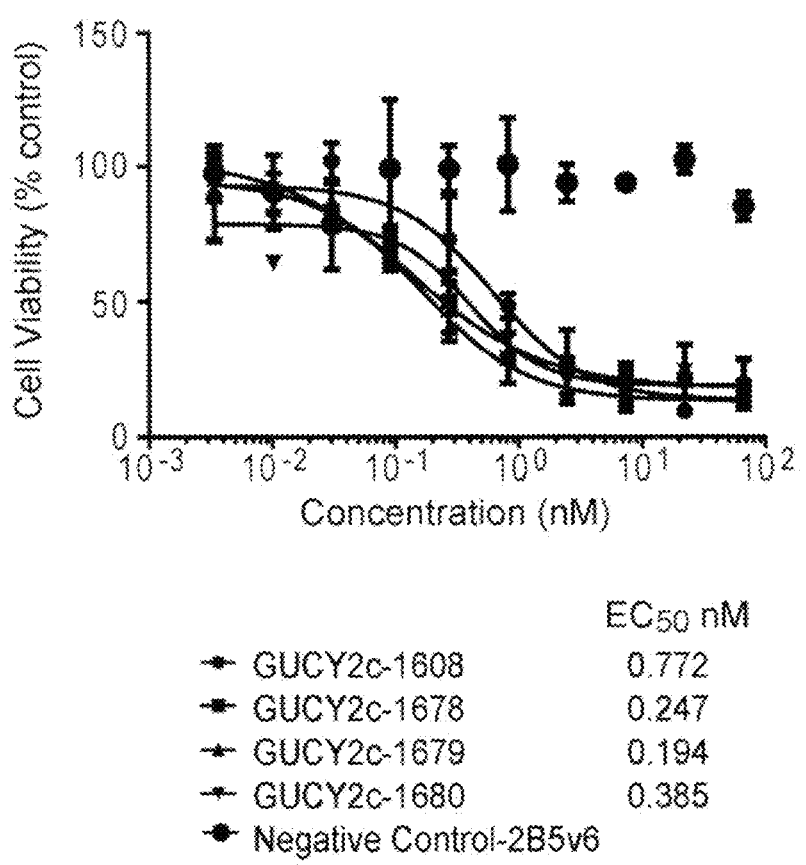

FIG. 18 depicts anti-GUCY2C bispecific T cell mediated cytotoxicity with anti-CD3 variants. Anti-GUCY2c bispecifics with different CD3 variants recruit naïve human T cells to induce cells killing in T84 tumor cells.

Figure 19:
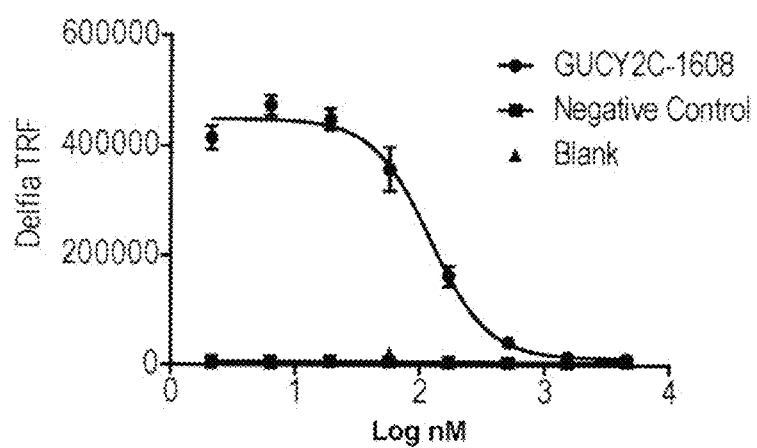

FIG. 19 depicts GUCY2c ECD Peptide Competition DELFIA ELISA.

Figure 20:
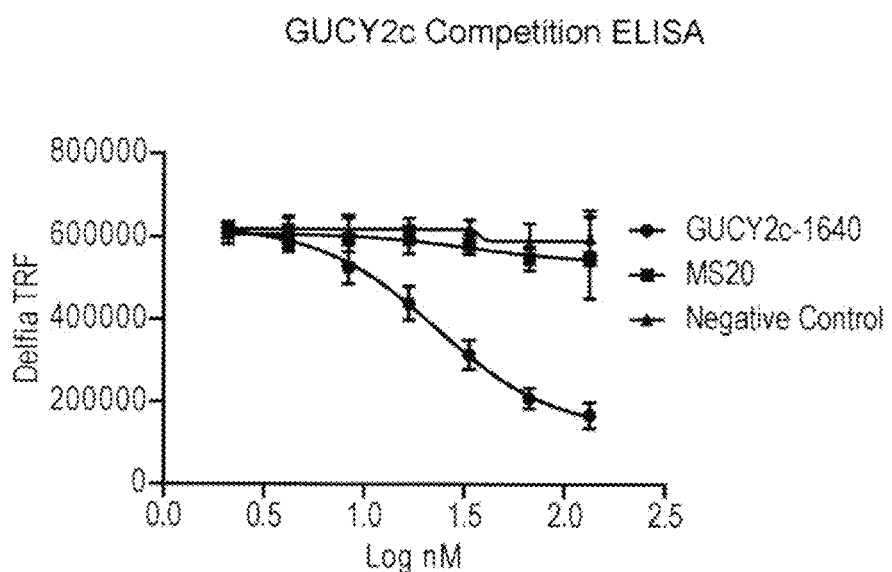

FIG. 20 depicts the competition DELFIA ELISA with Antibody MS20.

Figure 21:
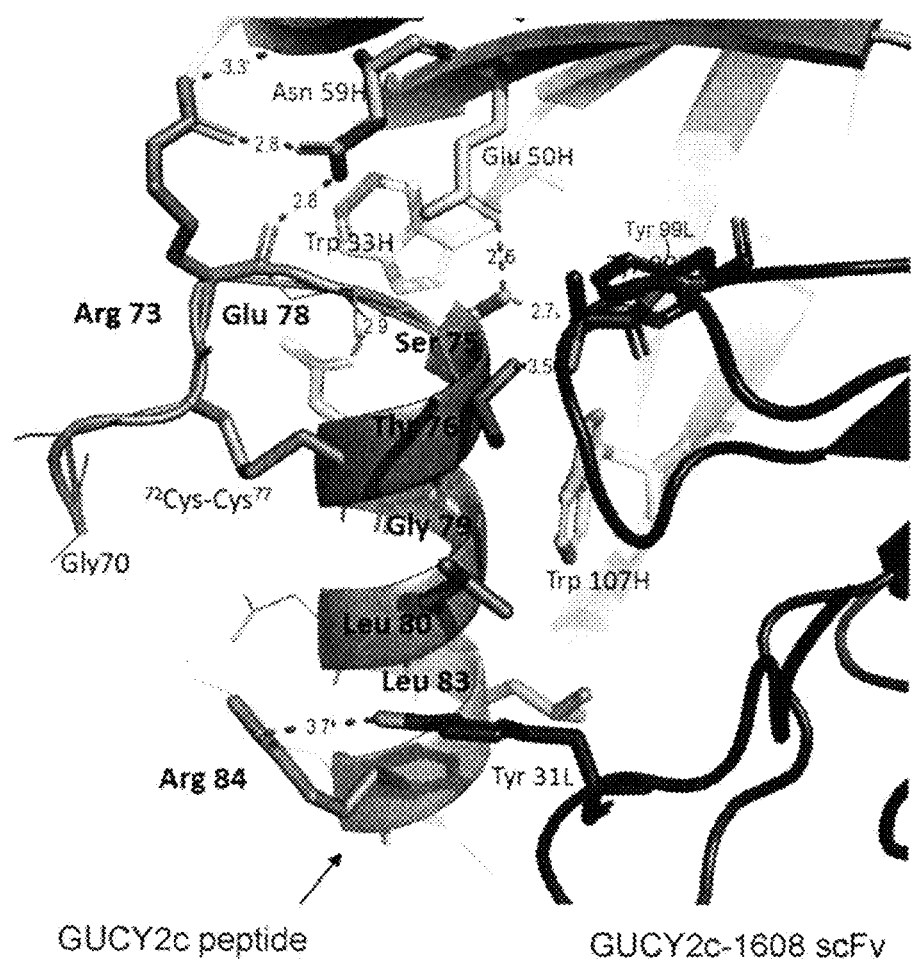

FIG. 21 depicts details of the binding interface of GUCY2c peptide and GUCY2C-1608 scFv peptide via crystallography.

Figure 22:
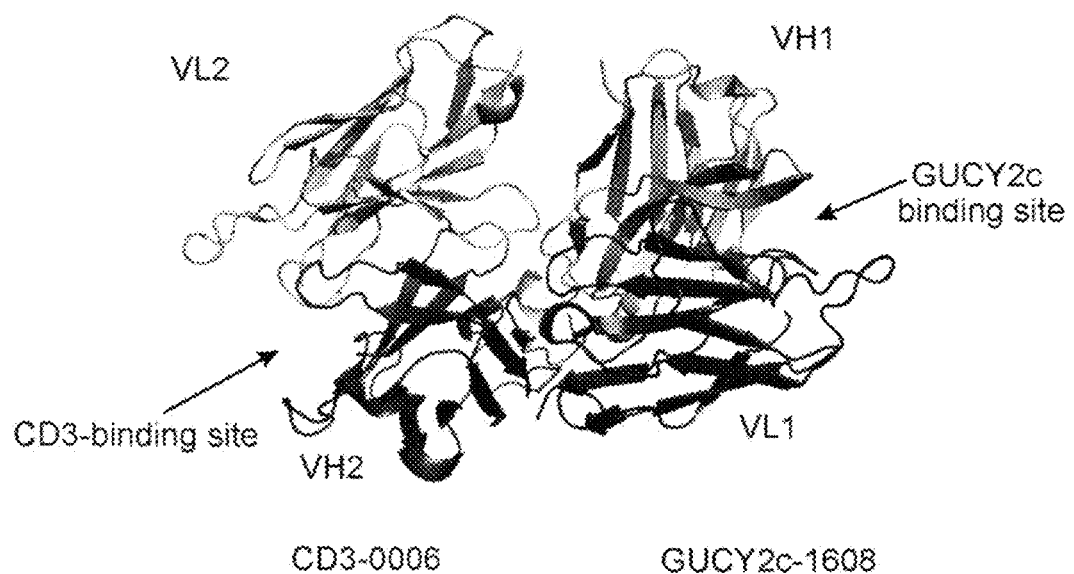

FIG. 22 depicts the crystal structure of the two antigen binding sites on the GUCY2c CD3 bispecific antibody showing that they are separated by about 70 Å and are located on the opposite sides of the molecule, directly across from each other.

Figure 23:
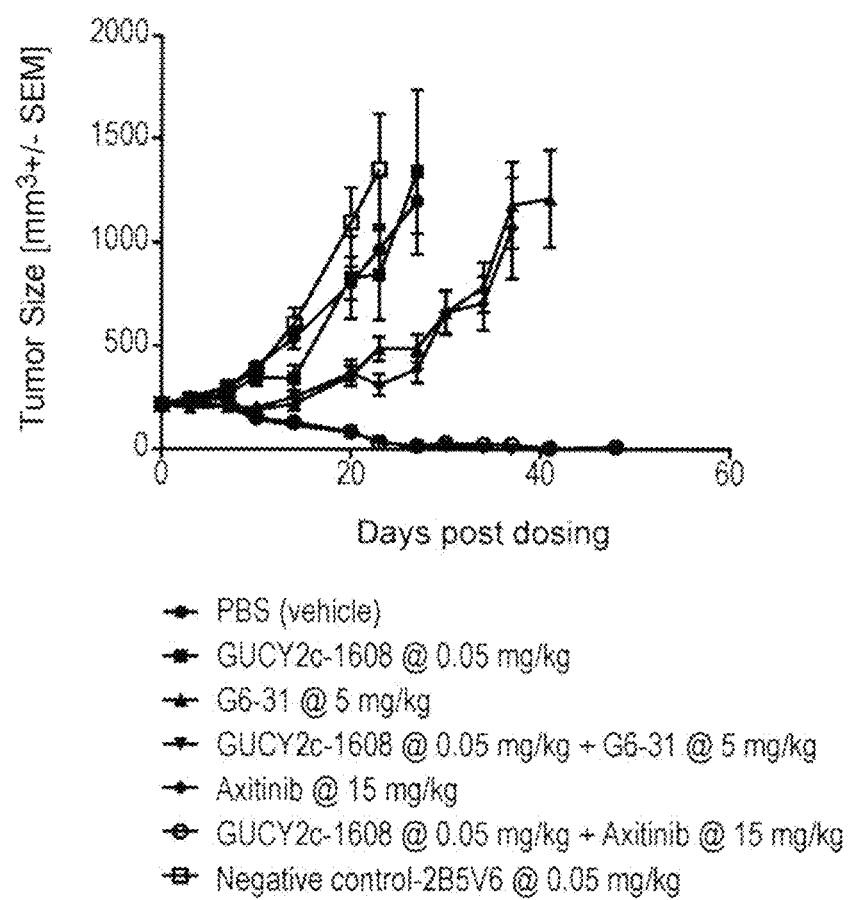

FIG. 23 depicts the results of combination studies with Anti-VEGF and axitinib that showed additive tumor growth inhibition in combination with GUCY2c CD3 bispecific.

Figure 24:
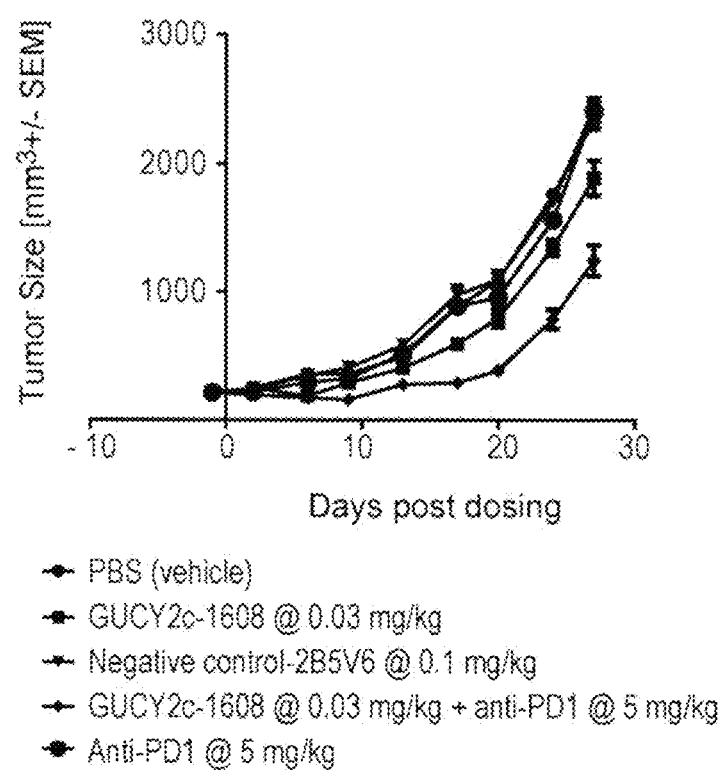

FIG. 24 depicts the results of combination studies with Anti-PD1 that showed additive tumor growth inhibition in combination with GUCY2c CD3 bispecific.

Figure 25:
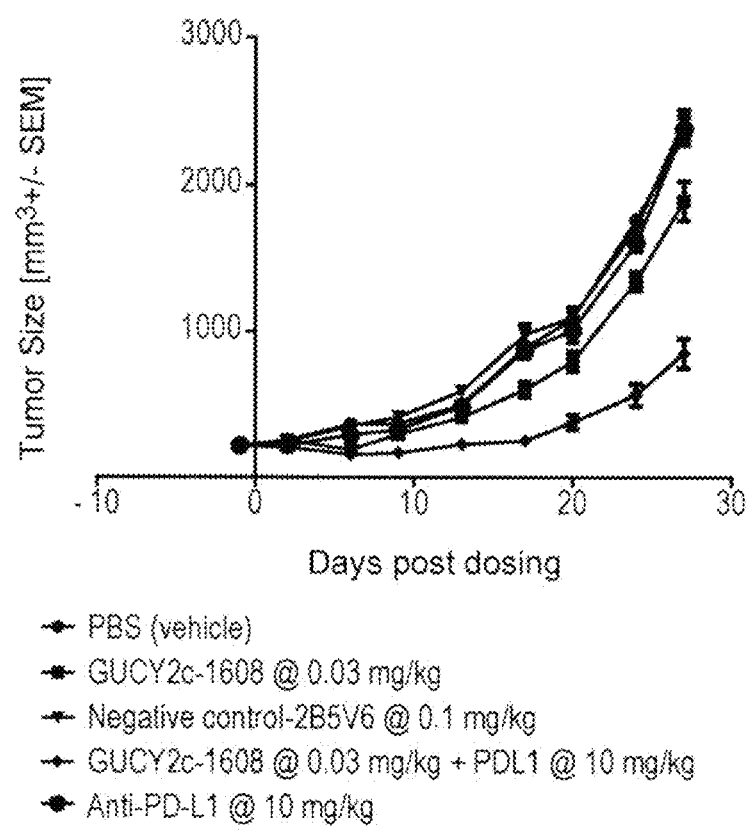

FIG. 25 depicts the results of combination studies with Anti-PD-L1 that showed additive tumor growth inhibition in combination with GUCY2c CD3 bispecific.

DETAILED DESCRIPTION

The invention disclosed herein provides antibodies that specifically bind to GUCY2c (e.g., human GUCY2c, mouse GUCY2c, rat GUCY2c, cynomolgus GUCY2c). Further, the invention disclosed herein provides bispecific antibodies that specifically bind to CD3 (e.g., human CD3) and a tumor antigen (e.g., GUCY2c). The invention also provides polynucleotides encoding these antibodies, compositions comprising these antibodies, and methods of making and using these antibodies. The invention further provides methods for treating a condition associated with GUCY2c expression in a subject, such as cancer, using the antibodies (e.g., GUCY2, CD3 or bispecific antibody), as described herein.

General Techniques

The practice of the present invention will employ, unless otherwise indicated, conventional techniques of molecular biology (including recombinant techniques), microbiology, cell biology, biochemistry and immunology, which are within the skill of the art. Such techniques are explained fully in the literature, such as, Molecular Cloning: A Laboratory Manual, second edition (Sambrook et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-1998) J. Wiley and Sons; Methods in Enzymology (Academic Press, Inc.); Handbook of Experimental Immunology (D. M. Weir and C. C. Blackwell, eds.); Gene Transfer Vectors for Mammalian Cells (J. M. Miller and M. P. Calos, eds., 1987); Current Protocols in Molecular Biology (F. M. Ausubel et al., eds., 1987); PCR: The Polymerase Chain Reaction, (Mullis et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practical approach (D. Catty., ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds., Harwood Academic Publishers, 1995). In some cases, terms with commonly understood meanings are defined herein for clarity and/or for ready reference, and the inclusion of such definitions herein should not necessarily be construed to represent a substantial difference over what is generally understood in the art.

The invention will now be described in detail by way of reference using the following definitions and examples. All patents and publications, including all sequences disclosed within such patents and publications, referred to herein are expressly incorporated by reference.

Definitions

In general, unless otherwise defined, all terms of art, notations and other scientific terms or terminology used herein are intended to have the meanings commonly understood by those of skill in the art to which this invention pertains. For example, the term "and/or" as used in a phrase such as "A and/or B" herein is intended to include both A and B; A or B; A (alone); and B (alone). Likewise, the term "and/or" as used in a phrase such as "A, B, and/or C" is intended to encompass each of the following embodiments: A, B, and C; A, B, or C; A or C; A or B; B or C; A and C; A and B; B and C; A (alone); B (alone); and C (alone).

As used herein, the singular forms "a", "an" and "the" include their corresponding plural references unless the context clearly dictates otherwise.

As used herein, the numeric ranges are inclusive of the numbers defining the range.

The terms "about", "approximately", and the like, when preceding a list of numerical values or range, refer to each individual value in the list or range independently as if each individual value in the list or range was immediately preceded by that term.

The terms mean that the values to which the same refer are exactly, close to, or similar thereto. For instance, in some embodiments, about or approximately a particular value may indicate a value of 99%, 95%, or 90% of that value. As an example, the expression of "about 100" includes 99 and 101 and all values in between (e.g., 99.1, 99.2, 99.3, 99.4, 99.5, etc.). As another example, where the temperature is 70° C., "about" or "approximately" 70° C. may equal 69° C., 66° C., or 63° C. It is to be understood that these are merely examples.

As used herein "within 3.8 Angstroms" means the contacts are less than or equal to 3.8 Angstroms as determined by crystallography.

As used herein, nucleic acids are written left to right in 5' to 3' direction; amino acid sequences are written left to right in amino to carboxy orientation, respectively. Practitioners are particularly directed to Sambrook et al., 1 989, and Ausubel F M et al., 1993, for definitions and terms of the art. It is to be understood that this invention is not limited to the particular methodology, protocols, and reagents described, as these may vary.

The terms "polypeptide", "oligopeptide", "peptide" and "protein" are used interchangeably herein to refer to chains of amino acids of any length, preferably, relatively short (e.g., 10-100 amino acids). The chain may be linear or branched, it may comprise modified amino acids, and/or may be interrupted by non-amino acids. The terms also encompass an amino acid chain that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. It is understood that the polypeptides can occur as single chains or associated chains. Preferably, mammalian polypeptides (polypeptides that were originally derived from a mammalian organism) are used, more preferably those which are directly secreted into the medium.

An "antibody" is an immunoglobulin molecule capable of specific binding to a target, such as a carbohydrate, polynucleotide, lipid, polypeptide, etc., through at least one antigen recognition site, located in the variable region of the immunoglobulin molecule. As used herein, the term encompasses a polyclonal, a monoclonal antibody, a chimeric antibody, a bispecific antibody, dual-specific antibody, bifunctional antibody, a trispecific antibody, a multispecific antibody, a bispecific heterodimeric diabody, a bispecific heterodimeric IgG, a labeled antibody, a humanized antibody, a human antibody, and fragments thereof (such as Fab, Fab', F(ab')$_2$, Fv), single chain (ScFv) and domain antibodies (including, for example, shark and camelid antibodies), fusion proteins comprising an antibody, and any other modified configuration of the immunoglobulin molecule that comprises an antigen recognition site. An antibody includes an antibody of any class, such as IgG, IgA, or IgM (or sub-class thereof), and the antibody need not be of any particular class. Depending on the antibody amino acid sequence of the constant region of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant regions that correspond to the different classes of immunoglobulins are called alpha, delta, epsilon, gamma, and mu, respectively. The subunit structures and three-dimensional configurations of different classes of immunoglobulins are well known. The invention also includes "antibody analog(s)," other non-antibody molecule protein-based scaffolds, e.g., fusion proteins and/or immunoconjugates that use CDRs to provide specific antigen binding. The antibodies of the invention can be derived from any species including, but not limited to mouse, human, camel, llama, fish, shark, goat, rabbit, chicken, and bovine.

The term "antibody" further includes immunoglobulin molecules comprising four polypeptide chains, two heavy (H) chains and two light (L) chains inter-connected by disulfide bonds, as well as multimers thereof (e.g., IgM). Each heavy chain comprises a heavy chain variable region (abbreviated herein as HC VR or VH) and a heavy chain constant region. A "variable region" of an antibody refers to the variable region of the antibody light chain or the variable region of the antibody heavy chain, either alone or in combination. The heavy chain constant region comprises three domains, CH1, CH2 and CH3. The CH1 and CH2 domains are connected by a hinge region. Each light chain comprises a light chain variable region (abbreviated herein as LC VR or VL) and a light chain constant region. The light chain constant region comprises one domain (CL1). The VH and VL regions can be further subdivided into regions of hypervariability, termed complementarity determining regions (CDRs), interspersed with regions that are more conserved, termed framework regions (FR). Each VH and VL is composed of three CDRs and four FRs, arranged from amino-terminus to carboxy-terminus in the following order: FR1, CDR1, FR2, CDR2, FR3, CDR3, FR4. In different embodiments of the invention, the FRs of the CD3 antibody (or antigen-binding portion thereof) may be identical to the human germline sequences, or may be naturally or artificially modified. An amino acid consensus sequence may be defined based on a side-by-side analysis of two or more CDRs. The CDRs in each chain are held together in close proximity by the FRs and, with the CDRs from the other chain, contribute to the formation of the antigen binding site of antibodies.

The term "antigen-binding fragment," or "antibody fragment" or "antigen-binding portion," as used herein, refers to one or more fragments of an antibody that retain the ability to specifically bind to an antigen. Examples of binding fragments encompassed within the term "antigen-binding fragment" of an antibody include (i) an antibody heavy chain variable domain (VH) and/or an antibody light chain variable domain (VL), or a pair of VH/VL derived from full length antibodies or antibody fragments such as a VH domain and/or a VL domain; (ii) a Fab fragment, a monovalent fragment consisting of the VL, VH, CL and CH1 domains; (iii) a Fab' fragment, which is essentially a Fab with part of the hinge region (e.g., Fundamental Immunology, Paul ed., 3.sup.rd ed. 1993; (iv) a F(ab')$_2$ fragment, a bivalent fragment comprising two Fab fragments linked by a disulfide bridge at the hinge region; (v) a Fd fragment consisting of the VH and CH1 domains; (vi) an Fv fragment consisting of the VL and VH domains of a single arm of an antibody; (vii) a single chain Fv fragment (scFv), a single protein chain in which the VL and VH regions pair to form monovalent molecules (e.g., Bird et al. (1988) Science 242:423-426; and Huston et al. (1988) Proc. Natl. Acad. Sci. USA 85:5879-5883); (viii) a disulfide stabilized Fv fragment (dsFv), an Fv with an engineered intermolecular disulfide bond to stabilize the VH-VL pair; (ix) a single variable domain antibody (sdAb or dAb) fragment (e.g., Ward et al., (1989) Nature 341:544-546), which is composed of a variable domain of heavy chain and devoid of the light chain; (x) a complementarity determining region (CDR); and any derivatives thereof.

As used herein, an "antigen-binding fragment" of an antibody may comprise at least one variable domain. The variable domain may be of any size or amino acid composition and will generally comprise at least one CDR which is adjacent to or in frame with one or more framework sequences. As used herein, an "antigen-binding fragment of an antibody" may comprise a homo-dimer or hetero-dimer (or other multimer) of any of the variable region and constant domain configurations listed below in non-covalent association with one another and/or with one or more monomeric VH or VL region (e.g., by disulfide bond(s)). For example, the variable region may be dimeric and contain VH-VH, VH-VL or VL-VL dimers. The configurations of variable and constant domains that may be found within an antigen-binding fragment of an antibody of the present invention include: VH-CH1; VH-CH2; VH-CH3; VH-CH1-CH2; VH-CH1-CH2-CH3; VH-CH2-CH3; VH-VL-CL, VH-VL-CH1, VH-VL-CH2; VH-CL; VL-CH1; VL-CH2; VL-CH3; VL-CH1-CH2; VL-CH1-CH2-CH3; VL-CH2-CH3; and VL-CL. The variable regions and constant domains may be either directly linked to one another or may be linked by a full or partial hinge or linker region. A hinge region may consist of at least 2 (e.g., 5, 10, 15, 20, 40, 60 or more) amino acids which result in a flexible or semi-flexible linkage between adjacent variable regions and/or constant domains in a single polypeptide molecule.

As used herein, a "binding domain" comprises any region of a polypeptide (e.g., antibody) which is responsible for selectively binding to a molecule of interest (e.g. an antigen, ligand, receptor, substrate or inhibitor). Exemplary binding domains include an antibody variable region, receptor binding domain, ligand binding domain and an enzymatic domain.

As used herein, the term "human acceptor framework" is a framework comprising the amino acid sequence of a light chain variable (VL) framework or a heavy chain variable (VH) framework derived from a human immunoglobulin framework or a human consensus framework, as defined below. A human acceptor framework "derived from" a human immunoglobulin framework or a human consensus framework may comprise the same amino acid sequence thereof, or it may contain amino acid sequence modifications. In some embodiments, the number of amino acid modifications are 10 or less, 9 or less, 8 or less, 7 or less, 6 or less, 5 or less, 4 or less, 3 or less, or 2 or less. In some embodiments, the VL human acceptor framework is identical in sequence to the VL human immunoglobulin framework sequence or human consensus framework sequence.

As used herein, an "affinity matured" antibody refers to an antibody with one or more modifications in one or more variable regions (which include the CDRs and FRs compared to a parent antibody, which does not possess such modifications, and wherein such modifications result in an improvement in the affinity of the antibody for an antigen.

As used herein, the term "Fc region," "Fc domain," "Fc chain" or analogous terms are used to define a C-terminal region of an IgG heavy chain. The Fc region of an IgG comprises two constant domains, CH2 and CH3. The CH2 domain of a human IgG Fc region usually extends from amino acids 231 to amino acid 340 according to the numbering system of the EU Index, or from amino acid 244 to amino acid 360 according to the numbering system of Kabat. The CH3 domain of a human IgG Fc region usually extends from amino acids 341 to 447 according to the numbering system of the EU index or from amino acid 361 to amino acid 478 according to the numbering system of Kabat. The CH2 domain of a human IgG Fc region (also referred to as "Cγ 2" domain) is unique in that it is not closely paired with another domain. Rather, two N-linked branched carbohydrate chains are interposed between the two CH2 domains of an intact native IgG. The Fc region may comprise native or variant Fc sequences. Although the boundaries of the Fc sequence of an immunoglobulin heavy chain might vary, the human IgG heavy chain Fc sequence is usually defined to stretch from an amino acid residue at about position Cys226, or from about position Pro230, to the carboxyl terminus of the Fc sequence. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

In certain embodiments, an Fc chain begins in the hinge region just upstream of the papain cleavage site and ends at the C-terminus of the antibody. Accordingly, a complete Fc chain comprises at least a hinge domain, a CH2 domain, and a CH3 domain. In certain embodiments, an Fc chain comprises at least one of: a hinge (e.g., upper, middle, and/or lower hinge region) domain, a CH2 domain, a CH3 domain, a CH4 domain, or a variant, portion, or fragment thereof. In certain embodiments, an Fc domain comprises a complete Fc chain (i.e., a hinge domain, a CH2 domain, and a CH3 domain). In certain embodiments, an Fc chain comprises a hinge domain (or portion thereof) fused to a CH3 domain (or portion thereof). In certain embodiments, an Fc chain comprises a CH2 domain (or portion thereof) fused to a CH3 domain (or portion thereof). In certain embodiments, an Fc chain consists of a CH3 domain or portion thereof. In certain embodiments, an Fc chain consists of a hinge domain (or portion thereof) and a CH3 domain (or portion thereof). In certain embodiments, an Fc chain consists of a CH2 domain (or portion thereof) and a CH3 domain. In certain embodiments, an Fc chain consists of a hinge domain (or portion thereof) and a CH2 domain (or portion thereof). In certain embodiments, an Fc chain lacks at least a portion of a CH2 domain (e.g., all or part of a CH2 domain). An Fc chain herein generally refers to a polypeptide comprising all or part of the Fc chain of an immunoglobulin heavy-chain. This includes, but is not limited to, polypeptides comprising the entire CHI, hinge, CH2, and/or CH3 domains as well as fragments of such peptides comprising only, e.g., the hinge, CH2, and CH3 domain. The Fc chain may be derived from an immunoglobulin of any species and/or any subtype, including, but not limited to, a human IgGI, IgG2, IgG3, IgG4, IgD, IgA, IgE, or IgM antibody. The Fc domain encompasses native Fc and Fc variant molecules. As with Fc variants and native Fc's, the term Fc chain includes molecules in monomeric or multimeric form, whether digested from whole antibody or produced by other means. In some embodiment, the Fc chain comprises the carboxy-terminal portions of both heavy chains held together by disulfides. In certain embodiments, an Fc chain consists of a CH2 domain and a CH3 domain.

As used in the art, "Fc receptor" and "FcR" describe a receptor that binds to the Fc region of an antibody. The preferred FcR is a native sequence human FcR. Moreover, a preferred FcR is one which binds an IgG antibody (a gamma receptor) and includes receptors of the FcγRI, FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. FcRs are reviewed in Ravetch and Kinet, Ann. Rev. Immunol., 9:457-92, 1991; Capel et al., Immunomethods, 4:25-34, 1994; and de Haas et al., J. Lab. Clin. Med., 126:330-41, 1995. "FcR" also includes the neonatal receptor, FcRn, which is responsible for the transfer of maternal IgGs to the fetus (Guyer et al., J. Immunol., 117:587, 1976; and Kim et al., J. Immunol., 24:249, 1994).

A "native sequence Fc region" or "wild-type Fc region" comprises an amino acid sequence identical to the amino acid sequence of an Fc region found in nature. By "wild-type" human IgG Fc it is meant a sequence of amino acids that occurs naturally within the human population. Of course, just as the Fc sequence may vary slightly between individuals, one or more alterations may be made to a wild-type sequence and still remain within the scope of the invention. For example, the Fc region may contain additional alterations that are not related to the present invention, such as a mutation in a glycosylation site, inclusion of an unnatural amino acid, or a "knobs-in-holes" mutation.

A "variant Fc region" or "variant Fc chain" comprises an amino acid sequence which differs from that of a native sequence Fc region by virtue of at least one amino acid modification yet retains at least one effector function of the native sequence Fc region. In some embodiments, the variant Fc chain has at least one amino acid substitution compared to a native sequence Fc chain or to the Fc region of a parent polypeptide, e.g., from about one to about ten amino acid substitutions, and preferably, from about one to about five amino acid substitutions in a native sequence Fc chain or in the Fc chain of the parent polypeptide. The variant Fc chain herein will preferably possess at least about 80% sequence identity with a native sequence Fc chain and/or with an Fc chain of a parent polypeptide, and most preferably, at least about 90% sequence identity therewith, more preferably, at least about 95%, at least about 96%, at least about 97%, at least about 98%, at least about 99% sequence identity therewith.

As used herein, the term "effector functions" refer to those biological activities attributable to the Fc chain (a native sequence Fc chain or amino acid sequence variant Fc chain) of an antibody, and vary with the antibody isotype. Examples of antibody effector functions include: C1q binding and complement dependent cytotoxicity; Fc receptor binding; antibody-dependent cell-mediated cytotoxicity (ADCC), phagocytosis; down regulation of cell surface receptors (e.g., B cell receptor); and B cell activation. Such effector functions generally require the Fc chain to be combined with a binding domain (e.g., an antibody variable region) and can be assessed using various assays known in the art for evaluating such antibody effector functions. An exemplary measurement of effector function is through Fcγ3 and/or C1q binding.

The effector functions of antibodies are determined by sequences in the Fc chain; this chain is also the part recognized by Fc receptors (FcR) found on certain types of cells.

In some embodiments, an Fc polypeptide comprises part or all of a wild-type hinge sequence (generally at its N-terminal). In some embodiments, an Fc polypeptide does not comprise a functional or wild-type hinge sequence.

The "hinge region," "hinge sequence," and variations thereof, as used herein, includes the meaning known in the art, which is illustrated in, for example, Janeway et al., ImmunoBiology: the immune system in health and disease, Elsevier Science Ltd., NY (4th ed., 1999); Bloom et al., Protein Science, 6:407-415, 1997; and Humphreys et al., J. Immunol. Methods, 209:193-202, 1997.

The "immunoglobulin-like hinge region," "immunoglobulin-like hinge sequence," or variations thereof, as used herein, refers to the hinge region and hinge sequence of an immunoglobulin-like or an antibody-like molecule (e.g., immunoadhesins). In some embodiments, the immunoglobulin-like hinge region can be from or derived from any IgG1, IgG2, IgG3, or IgG4 subtype, or from IgA, IgE, IgD or IgM, including chimeric forms thereof, e.g., a chimeric IgG1/2 hinge region.

In some embodiments, the hinge region can be from the human IgG1 subtype extending from amino acid 216 to amino acid 230 according to the numbering system of the EU index, or from amino acid 226 to amino acid 243 according to the numbering system of Kabat. In some embodiments the sequence may be EPKSCDKTHTCPPCP (SEQ ID NO: 186). Those of skill in the art may differ in their understanding of the exact amino acids corresponding to the various domains of the IgG molecule. Thus, the N-terminal or C-terminal of the domains outlined above may extend or be shortened by 1, 2, 3, 4, 5, 6, 7, 8, 9, or even 10 amino acids.

In some embodiments, the hinge region may be mutated by one or more amino acids. In some embodiments, the hinge region may be truncated and contain only a portion of the full hinge region. In some embodiments, the hinge region may contain only the last 5 amino acids of the hinge region.

As used herein, the terms "linked," "fused," "fusion," "covalently bound," "covalently coupled" and "genetically fused" are used interchangeably. These terms refer to the joining together of two more elements or components, by whatever means including chemical conjugation or recombinant means. As used herein, the term "covalently bound" means that the specified moieties are either directly covalently bonded to one another, or else are indirectly covalently joined to one another through an intervening moiety or moieties, such as a linking peptide or moiety. In a preferred embodiment, moieties are covalently fused. One type of covalent linkage is a peptide bond. Methods of chemical conjugation (e.g., using heterobifunctional cross-linking agents) are known in the art. Fused moieties may also be genetically fused. As used herein, the term "genetically fused," "genetically linked" or "genetic fused" refers to the co-linear, covalent linkage or attachment of two or more proteins, polypeptides, or fragments thereof via their individual peptide backbones, through genetic expression of a single polynucleotide molecule encoding those proteins, polypeptides, or fragments. Such genetic fusion results in the expression of a single contiguous genetic sequence. Preferred genetic fusions are in frame, i.e., two or more open reading frames (ORFs) are fused to form a continuous longer ORF, in a manner that maintains the correct reading frame of the original ORFs. Thus, the resulting recombinant fusion protein is a single polypeptide containing two or more protein segments that correspond to polypeptides encoded by the original ORFs (which segments are not normally so joined in nature). In this case, the single polypeptide is cleaved during processing to yield dimeric molecules comprising two polypeptide chains.

As used herein, the term "modification" refers to an amino acid substitution, insertion, and/or deletion in a polypeptide sequence, an alteration to a moiety chemically linked to a protein, or a modification of a function of a protein, e.g., an antibody. For example, a modification may be an altered function of an antibody, or an altered carbohydrate structure attached to a protein. As used herein, an "amino acid modification" refers to a mutation (substitution), insertion (addition), or deletion of one or more amino acid residue in an antibody. The term "amino acid mutation" denotes the substitution of at least one existing amino acid residue with another different amino acid residue (e.g. the replacing amino acid residue). The term "amino acid deletion" denotes the removal of at least one amino acid residue at a predetermined position in an amino acid sequence. For example, the mutation L234A denotes that the amino acid residue lysine at position 234 in an antibody Fc-region is substituted by the amino acid residue alanine (substitution of lysine with alanine), (numbering according to the EU index numbering system). A "naturally occurring amino acid residue" denotes an amino acid residue from the group consisting of alanine (three letter code: Ala, one letter code: A), arginine (Arg, R), asparagine (Asn, N), aspartic acid (Asp, D), cysteine (Cys, C), glutamine (Gin, Q), glutamic acid (Glu, E), glycine (Gly, G), histidine (His, H), isoleucine (He, I), leucine (Leu, L), lysine (Lys, K), methionine (Met, M), phenylalanine (Phe, F), proline (Pro, P), serine (Ser, S), threonine (Thr, T), tryptophan (Trp, W), tyrosine (Tyr, Y), and valine (Val, V).

As used herein, a "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., asparagine, glutamine, serine, threonine, tyrosine, cysteine), nonpolar side chains (e.g., glycine, alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

As used herein, a "non-essential" amino acid residue is a residue that can be altered from the wild-type sequence of the binding agent, e.g., the antibody, without abolishing or, without substantially altering a biological activity, whereas an "essential" amino acid residue results in such a change. In an antibody, an essential amino acid residue can be a specificity determining residue (SDR).

The term "agent" is used herein to denote a biological macromolecule, an extract made from biological materials, a mixture of biological macromolecules, a chemical compound, a mixture of chemical compounds, and/or a mixture of chemical compounds and biological macromolecules. The term "therapeutic agent" refers to an agent that has biological activity.

As used herein, "monoclonal antibody" refers to an antibody obtained from a population of substantially homogeneous antibodies, i.e., the individual antibodies comprising the population are identical except for possible naturally-occurring mutations that may be present in minor amounts. Monoclonal antibodies are highly specific, being directed against a single antigenic site. Furthermore, in contrast to polyclonal antibody preparations, which typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein, Nature 256:495, 1975, or may be made by recombinant DNA methods such as described in U.S. Pat. No. 4,816,567. The monoclonal antibodies may also be isolated from phage libraries generated using the techniques described in McCafferty et al., Nature 348:552-554, 1990, for example.

Antibodies of the present invention can be "humanized antibodies". As used herein, "humanized" antibody refers to forms of non-human (e.g., mouse, rat, rabbit, non-human primate or other mammal) antibodies that are chimeric immunoglobulins, immunoglobulin chains, or fragments thereof (such as Fv, Fab, Fab', F(ab')$_2$ or other antigen binding subsequences of antibodies) that contain one or more amino acid residues introduced into it from a source which is non-human. These non-human amino acid residues are often referred to as "import" residues, which are typically taken from an "import" variable domain. An import residue, sequence, or antibody has a desired affinity and/or specificity, or other desirable antibody biological activity as discussed herein.

Preferably, humanized antibodies are human immunoglobulins (recipient antibody) in which residues from a complementarity determining region (CDR) of the recipient are replaced by residues from a CDR of a non-human species (donor antibody) such as mouse, rat, or rabbit having the desired specificity, affinity, and capacity. In some instances, Fv framework region (FR) residues of the human immunoglobulin are replaced by corresponding non-human residues. Furthermore, the humanized antibody may comprise residues that are found neither in the recipient antibody nor in the imported CDR or framework sequences, but are included to further refine and optimize antibody performance. In general, the humanized antibody will comprise substantially all of at least one, and typically two, variable regions, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region or domain (Fc), typically that of a human immunoglobulin. Preferred are antibodies having Fc chains modified as described in WO 99/58572. Other forms of humanized antibodies have one or more CDRs (CDR L1, CDR L2, CDR L3, CDR H1, CDR H2, or CDR H3) which are altered with respect to the original antibody, which are also termed one or more CDRs "derived from" one or more CDRs from the original antibody. Humanized as used herein is intended to include de-immunized antibodies.

As used herein, "human antibody" means an antibody having an amino acid sequence corresponding to that of an antibody produced by a human and/or which has been made using any of the techniques for making human antibodies known to those skilled in the art or disclosed herein. Accordingly, the term "human antibody", as used herein, is intended to include antibodies having variable and constant regions derived from human germline immunoglobulin sequences. The human antibodies of the invention may include amino acid residues not encoded by human germline immunoglobulin sequences (e.g., mutations introduced by random or site-specific mutagenesis in vitro or by somatic mutation in vivo), for example in the CDRs and in particular CDR3. This definition of a human antibody includes antibodies comprising at least one human heavy chain polypeptide or at least one human light chain polypeptide. One such example is an antibody comprising murine light chain and human heavy chain polypeptides. Human antibodies can be produced using various techniques known in the art. In one embodiment, the human antibody is selected from a phage library, where that phage library expresses human antibodies (Vaughan et al., Nature Biotechnology, 14:309-314, 1996; Sheets et al., Proc. Natl. Acad. Sci. (USA) 95:6157-6162, 1998; Hoogenboom and Winter, J. Mol. Biol., 227:381, 1991; Marks et al., J. Mol. Biol., 222:581, 1991). Human antibodies can also be made by immunization of animals into which human immunoglobulin loci have been transgenically introduced in place of the endogenous loci, e.g., mice in which the endogenous immunoglobulin genes have been partially or completely inactivated. This approach is described in U.S. Pat. Nos. 5,545,807; 5,545,806; 5,569, 825; 5,625,126; 5,633,425; and 5,661,016. Alternatively, the human antibody may be prepared by immortalizing human B lymphocytes that produce an antibody directed against a target antigen (such B lymphocytes may be recovered from an individual or from single cell cloning of the cDNA, or may have been immunized in vitro). See, e.g., Cole et al. Monoclonal Antibodies and Cancer Therapy, Alan R. Liss, p. 77, 1985; Boerner et al., J. Immunol., 147(1):86-95, 1991; and U.S. Pat. No. 5,750,373.

The human antibodies of the present invention can exist in at least two forms that are associated with hinge heterogeneity. For example, the immunoglobulin molecule comprises a stable four chain construct of approximately 150-160 kDa in which the dimers are held together by an interchain heavy chain disulfide bond. Alternatively, the dimers are not linked via inter-chain disulfide bonds and a molecule of about 75-80 kDa is formed composed of a covalently coupled light and heavy chain (half-antibody).

As used herein, the term "recombinant human antibody" is intended to include all human antibodies that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

Antibodies of the invention can be "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, provided that they exhibit the desired biological activity (U.S. Pat. No. 4,816,567; and Morrison et al., Proc. Natl. Acad. Sci. USA 81:6851-6855, 1984). Chimeric antibodies of interest herein include primatized antibodies comprising variable region antigen-binding sequences derived from a non-human primate (e.g., Old World Monkey, Ape, etc.) and human constant region sequences.

A "monovalent antibody" comprises one antigen binding site per molecule (e.g., IgG or Fab). In some instances, a monovalent antibody can have more than one antigen binding sites, but the binding sites are from different antigens.

A "monospecific antibody" refers to an antibody or antibody preparation that comprises two identical antigen binding sites per molecule (e.g., IgG) such that the two binding sites bind identical epitope on the antigen. Thus, they compete with each other on binding to one antigen molecule. This term includes a "monoclonal antibody" or "monoclonal antibody composition." Most antibodies found in nature are monospecific. In some instances, a monospecific antibody can also be a monovalent antibody (e.g., Fab).

A "bivalent antibody" comprises two antigen binding sites per molecule (e.g., IgG).

In some instances, the two binding sites have the same antigen specificities. However, bivalent antibodies may be bispecific.

As used herein, a "bispecific antibody", "dual-specific antibody", "bifunctional antibody", "heteromultimer", "heteromultimeric complex", "bispecific heterodimeric diabody" or a "heteromultimeric polypeptide" is a molecule comprising at least a first polypeptide and a second polypeptide, wherein the second polypeptide differs in amino acid sequence from the first polypeptide by at least one amino acid residue. In some instances, the bispecific is an artificial hybrid antibody having two different heavy chain region and light chain region. Preferably, the bispecific antibody has binding specificity for at least two different ligands, antigens or binding sites. Accordingly, the bispecific antibodies can bind simultaneously two different antigens. The two antigen binding sites of a bispecific antibody bind to two different epitopes, which may reside on the same or different protein targets, e.g., tumor target.

A "target antigen," a "target cell antigen," a "tumor antigen," or a "tumor specific antigen," as used herein refers to an antigenic determinant presented on the surface of a target cell, for example a cell in a tumor such as a cancer cell or a cell of the tumor stroma.

The terms "mutation load," "mutational load," "mutation burden," and "mutational burden" are used interchangeably herein. Tumor mutational load is a measure of the number of mutations within a tumor genome, defined as the total number of mutations per coding area of a tumour genome. There is large variability in mutation burden within tumour types, ranging from just a few to 1000s of mutations (Alexandrov L B et al., Nature 2013; 500(7463):415-421; Lawrence M S et al., Nature 2013; 499:214-218; Vogelstein B et al., Science, 2013; 339:1546-1558.

As used herein, the first polypeptide chain and the second polypeptide chain of the "bispecific antibody" comprise at least one antibody VL and one antibody VH region or fragment thereof, wherein both antibody binding domains are comprised within a single polypeptide chain and wherein the VL and VH regions in each polypeptide chain are from different antibodies.

The bispecific antibody, dual-specific antibody, bifunctional antibody, heteromultimer, heteromultimeric complex, bispecific heterodimeric diabody or the heteromultimeric polypeptide can form higher order tertiary structures where other polypeptides in addition to the first and second polypeptide are present. The polypeptides of the heteromultimer may interact with each other by a non-peptidic, covalent bond (e.g., disulfide bond) and/or a non-covalent interaction (e.g., hydrogen bonds, ionic bonds, van der Waals forces, and/or hydrophobic interactions).

The bispecific antibody, dual-specific antibody, bifunctional antibody, heteromultimer, heteromultimeric complex, bispecific heterodimeric diabody or the heteromultimeric polypeptide can be prepared by constructing sFv fragments with short linkers (e.g., about 3-10 residues) between the VH and VL regions such that inter-chain but not intra-chain pairing of the V regions is achieved, resulting in a bivalent fragment, i.e., fragment having two antigen-binding sites. Bispecific antibodies can be derived from full length antibodies or antibody fragments (e.g., F(ab')$_2$ bispecific antibodies). Diabodies are described more fully in, for example, EP404,097; WO93/11161; and Hollinger et al., Proc. Natl. Acad. Sci. USA 90:6444-6448, 1993. Bispecific antibodies are heterodimers of two "crossover" sFv fragments in which the VH and VL regions of the two antibodies are present on different polypeptide chains.

As used herein, an "isolated antibody" means an antibody that has been identified and separated and/or recovered from at least one component of its natural environment. For example, an antibody that has been separated or removed from at least one component of an organism, or from a tissue or cell in which the antibody naturally exists or is naturally produced, is an "isolated antibody" for purposes of the present invention. An isolated antibody also includes an antibody in situ within a recombinant cell. Isolated antibodies are antibodies that have been subjected to at least one purification or isolation step. According to certain embodiments, an isolated antibody may be substantially free of other cellular material and/or chemicals.

As used herein, the term "linked" or "links" refers to either a direct peptide bond linkage between a first and second amino acid sequence or a linkage that involves a third amino acid sequence that is peptide bonded to and between the first and second amino acid sequences. For example, a linker peptide bonded to the C-terminal end of one amino acid sequence and to the N-terminal end of the other amino acid sequence.

As used herein, the term "linker" refers to an amino acid sequence of two or more amino acids in length. The linker can consist of neutral polar or nonpolar amino acids. A linker can be, for example, 2 to 100 amino acids in length, such as between 2 and 50 amino acids in length, for example, 3, 5, 10, 15, 20, 25, 30, 35, 40, 45, or 50 amino acids in length. A linker can be "cleavable," for example, by auto-cleavage, or enzymatic or chemical cleavage. Cleavage sites in amino acid sequences and enzymes and chemicals that cleave at such sites are well known in the art and are also described herein.

As used herein, the term "disulfide bond" or "cysteine-cysteine disulfide bond" refers to a covalent interaction between two cysteines in which the sulfur atoms of the cysteines are oxidized to form a disulfide bond. The average bond energy of a disulfide bond is about 60 kcal/mol compared to 1-2 kcal/mol for a hydrogen bond. In the context of this invention, the cysteines which form the disulfide bond are within the framework regions of the single chain antibody and serve to stabilize the conformation of the antibody. Cysteine residues can be introduced, e.g., by site directed mutagenesis, so that stabilizing disulfide bonds can be made within the molecule.

The "knob-in-hole designation" is analogous to the "protuberance and cavity" designation and may be used interchangeably.

A "protuberance" or "knob" refers to at least one amino acid side chain which projects from the interface of the first polypeptide and is therefore positionable in a compensatory cavity in the adjacent interface (i.e., the interface of the second polypeptide) so as to stabilize the heterodimer, and thereby favor heterodimer formation over homodimer formation, for example. The protuberance may exist in the original interface or may be introduced synthetically (e.g., by altering nucleic acid encoding the interface). Normally, nucleic acid encoding the interface of the first polypeptide is altered to encode the protuberance. To achieve this, the nucleic acid encoding at least one original amino acid residue in the interface of the first polypeptide is replaced with nucleic acid encoding at least one import amino acid residue which has a larger side chain volume than the original amino acid residue. The upper limit for the number of original residues which are replaced is the total number of residues in the interface of the first polypeptide. Certain import residues for the formation of a protuberance are generally naturally occurring amino acid residues and are preferably selected from arginine (R), phenylalanine (F), tyrosine (Y) and tryptophan (W).

The protuberance or knob is "positionable" in the cavity or hole which means that the spatial location of the protuberance and cavity on the interface of the first polypeptide and second polypeptide respectively and the sizes of the protuberance and cavity are such that the protuberance may be located in the cavity without significantly perturbing the normal association of the first and second polypeptides at the interface. Since protuberances such as phenylalanine (F), tyrosine (Y) and tryptophan (W) do not typically extend perpendicularly from the axis of the interface, the alignment of a protuberance with a corresponding cavity relies on modeling the protuberance/cavity pair based upon a three-dimensional structure such as that obtained by X-ray crystallography or nuclear magnetic resonance (NMR). This can be achieved using widely accepted techniques in the art.

A "cavity" or "hole" refers to at least one amino acid side chain which is recessed from the interface of the second polypeptide and therefore accommodates a corresponding protuberance on the adjacent interface of the first polypeptide. The cavity may exist in the original interface or may be introduced synthetically (e.g., by altering nucleic acid encoding the interface). Normally, nucleic acid encoding the interface of the second polypeptide is altered to encode the cavity. To achieve this, the nucleic acid encoding at least one original amino acid residue in the interface of the second polypeptide is replaced with DNA encoding at least one "import" amino acid residue which has a smaller side chain volume than the original amino acid residue. The upper limit for the number of original residues which are replaced is the total number of residues in the interface of the second polypeptide. Certain import residues for the formation of a cavity are usually naturally occurring amino acid residues and are preferably selected from alanine (A), serine (S), threonine (T) and valine (V).

The terms "interface," "interface residue," "interface amino acid," "contact residue," or "contact amino acid," as used herein typically refers to any amino acid residue present in the domain that can be involved in first polypeptide and second polypeptide contacts.

An "original amino acid" residue is one which is replaced by an "import amino acid" residue which can have a smaller or larger side chain volume than the original residue. The import amino acid residue can be a naturally occurring or non-naturally occurring amino acid residue, but preferably is the former. "Naturally occurring" amino acid residues are those residues encoded by the genetic code. By "non-naturally occurring" amino acid residue is meant a residue which is not encoded by the genetic code, but which is able to covalently bind adjacent amino acid residue(s) in the polypeptide chain. Examples of non-naturally occurring amino acid residues are norleucine, ornithine, norvaline, homoserine and other amino acid residue analogues such as those described in Ellman et al., Meth. Enzym. 202:301-336 (1991), for example. In some embodiments, the method of the instant invention may involve replacing at least one original amino acid residue, but more than one original residue may be replaced. Normally, no more than the total residues in the interface of the first or second polypeptide may comprise original amino acid residues which are replaced.

The term "compete", as used herein with regard to an antibody, means that a first antibody, or an antigen-binding fragment (or portion) thereof, binds to an epitope in a manner sufficiently similar to the binding of a second antibody, or an antigen binding portion thereof, such that the result of binding of the first antibody with its cognate epitope is detectably decreased in the presence of the second antibody compared to the binding of the first antibody in the absence of the second antibody. The alternative, where the binding of the second antibody to its epitope is also detectably decreased in the presence of the first antibody, can, but need not be the case. That is, a first antibody can inhibit the binding of a second antibody to its epitope without that second antibody inhibiting the binding of the first antibody to its respective epitope. However, where each antibody detectably inhibits the binding of the other antibody with its cognate epitope or ligand, whether to the same, greater, or lesser extent, the antibodies are said to "cross-compete" with each other for binding of their respective epitope(s). Both competing and cross-competing antibodies are encompassed by the present invention. Regardless of the mechanism by which such competition or cross-competition occurs (e.g., steric hindrance, conformational change, or binding to a common epitope, or portion thereof), the skilled artisan would appreciate, based upon the teachings provided herein, that such competing and/or cross-competing antibodies are encompassed and can be useful for the methods disclosed herein.

As used herein "antibody-dependent cell-mediated cytotoxicity" or "ADCC" refers to a cell-mediated reaction in which nonspecific cytotoxic cells that express Fc receptors (FcRs) (e.g., natural killer (NK) cells, neutrophils, and macrophages) recognize bound antibody on a target cell and subsequently cause lysis of the target cell. ADCC activity of a molecule of interest can be assessed using an in vitro ADCC assay, such as that described in U.S. Pat. Nos. 5,500,362 or 5,821,337. Useful effector cells for such assays include peripheral blood mononuclear cells (PBMC) and NK cells. Alternatively, or additionally, ADCC activity of the molecule of interest may be assessed in vivo, e.g., in an animal model such as that disclosed in Clynes et al., PNAS (USA), 95:652-656, 1998.

As used herein, a "complement dependent cytotoxicity" or "CDC" refers to the lysing of a target in the presence of complement. The complement activation pathway is initiated by the binding of the first component of the complement system (C1q) to a molecule (e.g., an antibody) complexed with a cognate antigen. To assess complement activation, a CDC assay, e.g., as described in Gazzano-Santoro et al., J. Immunol. Methods, 202: 163, 1996, may be performed.

As used herein, the terms "immunospecifically binds," "immunospecifically recognizes," "specifically binds," "specifically recognizes" and analogous terms refer to molecules e.g., binding domains that specifically bind to an antigen (e.g., epitope or immune complex) and do not specifically bind to another molecule. A molecule that specifically binds to an antigen may bind to other peptides or polypeptides with lower affinity as determined by assays known in the art e.g., immunoassays, BIACORE™, or other assays. Preferably, molecules that specifically bind an antigen do not cross-react with other proteins.

Suitable "moderately stringent conditions" include pre-washing in a solution of 5×SSC, 0.5% SDS, 1.0 mM EDTA (pH 8.0); hybridizing at 50° C.-65° C., 5×SSC, overnight; followed by washing twice at 65° C. for 20 minutes with each of 2×, 0.5× and 0.2×SSC containing 0.1% SDS.

As used herein, "highly stringent conditions" or "high stringency conditions" are those that: (1) employ low ionic strength and high temperature for washing, for example 0.015 M sodium chloride/0.0015 M sodium citrate/0.1% sodium dodecyl sulfate at 50° C., (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. The skilled artisan will recognize how to adjust the temperature, ionic strength, etc. as necessary to accommodate factors such as probe length and the like.

The binding proteins, binding domains, CDRs, or antibodies (as broadly defined herein) can be identified according to the definitions of the Kabat, Chothia, the accumulation of both Kabat and Chothia, AbM, contact, North, and/or conformational definitions or any method of CDR determination well known in the art. See, e.g., Kabat et al., 1991, Sequences of Proteins of Immunological Interest, 5th ed. (hypervariable regions); Chothia et al., Nature 342:877-883, 1989 (structural loop structures). The identity of the amino acid residues in a particular antibody that make up a CDR can be determined using methods well known in the art. The AbM definition of CDRs is a compromise between Kabat and Chothia and uses Oxford Molecular's AbM antibody modeling software (Accelrys®). The "contact" definition of CDRs is based on observed antigen contacts, set forth in MacCallum et al., J. Mol. Biol., 262:732-745, 1996. The "conformational" definition of CDRs is based on residues that make enthalpic contributions to antigen binding (see, e.g., Makabe et al., J. Biol. Chem., 283:1156-1166, 2008). North has identified canonical CDR conformations using a different preferred set of CDR definitions (North et al., J. Mol. Biol. 406: 228-256, 2011). In another approach, referred to herein as the "conformational definition" of CDRs, the positions of the CDRs may be identified as the residues that make enthalpic contributions to antigen binding (Makabe et al., J Biol. Chem. 283:1156-1166, 2008). Still other CDR boundary definitions may not strictly follow one of the above approaches, but will nonetheless overlap with at least a portion of the Kabat CDRs, although they may be shortened or lengthened in light of prediction or experimental findings that particular residues or groups of residues or even entire CDRs do not significantly impact antigen binding. As used herein, a CDR may refer to CDRs defined by any approach known in the art, including combinations of approaches. The methods used herein may utilize CDRs defined according to any of these approaches. For any given embodiment containing more than one CDR, the CDRs (or other residue of the antibody) may be defined in accordance with any of Kabat, Chothia, extended (combination of Kabat and Chothia), North, extended, AbM, contact, and/or conformational definitions.

Residues in a variable domain are numbered according Kabat, which is a numbering system used for heavy chain variable regions or light chain variable regions of the compilation of antibodies. See, Kabat et al., Sequences of Proteins of Immunological Interest, 5th Ed. Public Health Service, National Institutes of Health, Bethesda, Md., 1991. Using this numbering system, the actual linear amino acid sequence may contain fewer or additional amino acids corresponding to a shortening of, or insertion into, a FR or CDR of the variable region. For example, a heavy chain variable region may include a single amino acid insert (residue 52a according to Kabat) after residue 52 of H2 and inserted residues (e.g., residues 82a, 82b, and 82c, according to Kabat) after heavy chain FR residue 82. The Kabat numbering of residues may be determined for a given antibody by alignment at regions of homology of the sequence of the antibody with a "standard" Kabat numbered sequence. Various algorithms for assigning Kabat numbering are available. The algorithm implemented in the version 2.3.3 release of Abysis (www.abysis.org) was used herein to assign Kabat numbering to variable regions VL CDR1, VL CDR2, VL CDR3, VH CDR2, and VH CDR3. The AbM definition was used for VH CDR1. Specific amino acid residue positions in an antibody may also be numbered according to Kabat.

As used herein, the term "phage display library" refers to a population of bacteriophage, each of which contains a foreign cDNA recombinantly fused in frame to a surface protein. The phage displays the foreign protein encoded by the cDNA on its surface. After replication in a bacterial host, typically *E. coli*, the phage which contains the foreign cDNA of interest are selected by the expression of the foreign protein on the phage surface.

The term "epitope" refers to that portion of a molecule capable of being recognized by, making contact and/or being bound by an antibody at one or more of the antibody's antigen-binding regions known as a paratope. A single antigen may have more than one epitope. Thus, different antibodies may bind to different areas on an antigen and may have different biological effects. Epitopes often consist of a chemically active surface grouping of molecules such as amino acids or sugar side chains and have specific three-dimensional structural characteristics as well as specific charge characteristics. As used herein, epitopes may be either conformational or linear. A conformational epitope is produced by spatially juxtaposed amino acids from different segments of the linear polypeptide chain. A linear epitope is one produced by adjacent amino acid residues in a polypeptide chain. In certain embodiments, an epitope may include moieties of saccharides, phosphoryl groups, or sulfonyl groups on the antigen.

The term "antigenic epitope" as used herein, is defined as a portion of a polypeptide to which an antibody can specifically bind as determined by any method well known in the art, for example, by conventional immunoassays. A "nonlinear epitope" or "conformational epitope" comprises noncontiguous polypeptides (or amino acids) within the antigenic protein to which an antibody specific to the epitope binds. Once a desired epitope on an antigen is determined, it is possible to generate antibodies to that epitope, e.g., using the techniques described herein.

The terms "specific binding" or "specifically binding" when used in reference to the interaction of an antibody and a protein or peptide refers to an interaction that is dependent upon the presence of a particular structure (i.e., the antigenic determinant or epitope) on the protein; in other words the antibody is recognizing and binding to a specific protein structure rather than to proteins in general. For example, if an antibody is specific for epitope "A," the presence of a protein containing epitope A (or free, unlabeled A) in a reaction containing labeled "A" and the antibody will reduce the amount of labeled A bound to the antibody.

In certain embodiments "specifically binds" means, for instance, that an antibody binds a protein with a $K_D$ of about 0.1 nM or less, but more usually less than about 1 μM. In certain embodiments, "specifically binds" means that an antibody binds a target at times with a $K_D$ of at least about 0.1 μM or less, at other times at least about 0.01 μM or less, and at other times at least about 1 nM or less. Because of the sequence identity between homologous proteins in different species, specific binding can include an antibody that recognizes a protein in more than one species (e.g., human GUCY2c and mouse GUCY2c). Likewise, because of homology within certain regions of polypeptide sequences of different proteins, specific binding can include an antibody that recognizes more than one protein. It is understood that, in certain embodiments, an antibody or binding moiety that specifically binds a first target may or may not specifically bind a second target. As such, "specific binding" does not necessarily require (although it can include) exclusive binding, i.e. binding to a single target. Thus, an antibody may, in some embodiments, specifically bind more than one target. In certain embodiments, multiple targets may be bound by the same antigen-binding site on the antibody. For example, an antibody may, in certain instances, comprise two identical antigen-binding sites, each of which specifically binds the same epitope on two or more proteins. In certain alternative embodiments, an antibody may be multispecific and comprise at least two antigen-binding sites with differing specificities. By way of non-limiting example, a bispecific antibody may comprise one antigen-binding site that recognizes an epitope on one protein (e.g., human CD3) and further comprise a second, different antigen-binding site that recognizes a different epitope on a second protein. Generally, but not necessarily, reference to binding means specific binding.

An antibody that specifically binds to an antigen may bind to other peptides or polypeptides with lower affinity as determined by assays known in the art e.g. immunoassays, BIACORE™, or other assays. Preferably, the antibody that specifically binds an antigen does not cross-react with other proteins.

The terms "non-specific binding" or "background binding" when used in reference to the interaction of an antibody and a protein or peptide refers to an interaction that is not dependent on the presence of a particular structure (i.e., the antibody is binding to proteins in general rather that a particular structure such as an epitope).

The term "$k_{on}$" or "$k_a$," as used herein, refers to the rate constant for association of an antibody to an antigen. Specifically, the rate constants ($k_{on}/k_a$ and $k_{off}/k_d$) and equilibrium dissociation constants are measured using whole antibody (i.e., bivalent) and monomeric GUCY2c proteins.

The term "$k_{off}$" or "$k_d$," as used herein, refers to the rate constant for dissociation of an antibody from the antibody/antigen complex.

The term "$K_D$," as used herein, refers to the equilibrium dissociation constant of an antibody-antigen interaction.

As used herein, the term "binding affinity," generally refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant ($K_D$). The affinity of a molecule X for its partner Y can generally be represented by the dissociation constant (Kd). For example, the Kd can be about 200 nM, 150 nM, 100 nM, 60 nM, 50 nM, 40 nM, 30 nM, 20 nM, 10 nM, 8 nM, 6 nM, 4 nM, 2 nM, 1 nM, or stronger. Affinity can be measured by common methods known in the art, including those described herein. Low-affinity antibodies generally bind antigen slowly and tend to dissociate readily, whereas high-affinity antibodies generally bind antigen faster and tend to remain bound longer. A variety of methods of measuring binding affinity are known in the art, any of which can be used for purposes of the present invention. In particular, the term "binding affinity" is intended to refer to the dissociation rate of a particular antigen-antibody interaction. The $K_D$ is the ratio of the rate of dissociation, also called the "off-rate ($k_{off}$)," to the association rate, or "on-rate ($k_{on}$)". Thus, $K_D$ equals $k_{off}/k_{on}$ and is expressed as a molar concentration (M). It follows that the smaller the $K_D$, the stronger the affinity of binding. Therefore, a $K_D$ of 1 μM indicates weak binding affinity compared to a $K_D$ of 1 nM. $K_D$ values for antibodies can be determined using methods well established in the art. One method for determining the $K_D$ of an antibody is by using surface plasmon resonance (SPR), typically using a biosensor system such as a BIACORE™ system. BIACORE™ kinetic analysis comprises analyzing the binding and dissociation of an antigen from chips with immobilized molecules (e.g., molecules comprising epitope binding domains), on their surface. Another method for determining the $K_D$ of an antibody is by using Bio-Layer Interferometry, typically using OCTET® technology (Octet $QK^e$ so system, ForteBio).

"Biologically active," "biological activity" and "biological characteristics" with respect to a bispecific antibody of the present invention, such as an antibody, fragment, or derivative thereof, means having the ability to bind to a biological molecule, except where specified otherwise.

As used herein, the terms "nucleic acids" and "nucleotide sequences" include DNA molecules (e.g., cDNA or genomic DNA), RNA molecules (e.g., mRNA), combinations of DNA and RNA molecules or hybrid DNA/RNA molecules, and analogs of DNA or RNA molecules. Such analogs can be generated using, for example, nucleotide analogs, which include, but are not limited to, inosine or tritylated bases. Such analogs can also comprise DNA or RNA molecules comprising modified backbones that lend beneficial attributes to the molecules such as, for example, nuclease resistance or an increased ability to cross cellular membranes. The nucleic acids or nucleotide sequences can be single-stranded, double-stranded, may contain both single-stranded and double-stranded portions, and may contain triple-stranded portions, but preferably is double-stranded DNA.

The present invention also includes polynucleotides that encode the antibodies of the invention, including the polypeptides and binding regions of the antibodies. The polynucleotides encoding the molecules of the invention may be obtained, and the nucleotide sequence of the polynucleotides determined, by any method known in the art.

The polynucleotides that encode the antibodies of the present invention may include the following: only the coding sequence for the variant, the coding sequence for the variant and additional coding sequences such as a functional polypeptide, or a signal or secretory sequence or a pro-protein sequence; the coding sequence for the antibody and non-coding sequence, such as introns or non-coding sequence 5' and/or 3' of the coding sequence for the antibody. The term "polynucleotide encoding an antibody" encompasses a polynucleotide which includes additional coding sequence for the variant but also a polynucleotide which includes additional coding and/or non-coding sequence. It is known in the art that a polynucleotide sequence that is optimized for a specific host cell/expression system can readily be obtained from the amino acid sequence of the desired protein (see GENEART® AG, Regensburg, Germany).

The antibodies and antigen-binding fragment thereof of the present invention may have additional conservative or non-essential amino acid substitutions, which do not have a substantial effect on the polypeptide functions. Whether or not a particular substitution will be tolerated, i.e., will not adversely affect desired biological properties, such as binding activity, can be determined as described in Bowie, J U et al. Science 247: 1306-1310,1990 or Padlan et al. FASEB J. 9: 133-139, 1995.

As used herein, the term "isolated" refers to material that is removed from its original environment (e.g., the natural environment if it is naturally occurring). For example, a naturally occurring polynucleotide or polypeptide present in a living animal is not isolated, but the same polynucleotide or polypeptide that is separated from some or all of the coexisting materials in the natural system is isolated. Such polynucleotide could be part of a vector and/or such polynucleotide or polypeptide could be part of a composition, e.g., a mixture, solution or suspension or comprising an isolated cell or a cultured cell which comprises the polynucleotide or polypeptide, and still be isolated in that the vector or composition is not part of its natural environment.

As used herein, the term "replicon" refers to any genetic element, such as a plasmid, a chromosome or a virus, that behaves as an autonomous unit of polynucleotide replication within a cell.

As used herein, the term "operably linked" refers to a situation wherein the components described are in a relationship permitting them to function in their intended manner. For example, a control sequence "operably linked" to a coding sequence is ligated in such a manner that expression of the coding sequence is achieved under conditions suitable or compatible with the control sequence. Generally, "operably linked" means that the DNA sequences being linked are contiguous and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accord with conventional practice.

As used herein, "vector" means a construct, which is capable of delivering, and, preferably, expressing, one or more gene(s) or sequence(s) of interest in a host cell. Examples of vectors include, but are not limited to, viral vectors, naked DNA or RNA expression vectors, plasmid, cosmid or phage vectors, DNA or RNA expression vectors associated with cationic condensing agents, DNA or RNA expression vectors so encapsulated in liposomes, and certain eukaryotic cells, such as producer cells.

As used herein, the term "expression control sequence" or "control sequence" refers to a polynucleotide sequence that is necessary to effect the expression of a coding sequence to which it is ligated. The nature of such control sequences differs depending upon the host organism. For example, in prokaryotes, such control sequences generally include a promoter, a ribosomal binding site and terminators and, in some instances, enhancers. The term "control sequence" thus is intended to include at a minimum all components whose presence is necessary for expression, and also may include additional components whose presence is advantageous, for example, leader sequences.

A "host cell" includes an individual cell or cell culture that can be or has been a recipient for vector(s) for incorporation of polynucleotide inserts. Host cells include progeny of a single host cell, and the progeny may not necessarily be completely identical (in morphology or in genomic DNA complement) to the original parent cell due to natural, accidental, or deliberate mutation. A host cell includes cells transfected in vivo with a polynucleotide(s) of this invention.

As used herein, "mammalian cells" include reference to cells derived from mammals including humans, rats, mice, guinea pigs, chimpanzees, or macaques. The cells may be cultured in vivo or in vitro.

As used herein, the term "purified product" refers to a preparation of the product which has been isolated from the cellular constituents with which the product is normally associated and/or from other types of cells that may be present in the sample of interest.

As used herein, "substantially pure" refers to material which is at least 50% pure (i.e., free from contaminants), more preferably, at least 90% pure, more preferably, at least 95% pure, yet more preferably, at least 98% pure, and most preferably, at least 99% pure.

As used herein, the term "cancer" or "cancerous" refers to or describes a physiological condition in mammals that is typically characterized by unregulated cell growth, a neoplasm or a tumor resulting from abnormal uncontrolled growth of cells. In some aspects, cancer refers to a malignant primary tumor without metastasis, which has remained localized. In other aspects, cancer refers to a malignant tumor, which has invaded and destroyed neighboring body structures and spread to distant sites. In some aspects, the cancer is associated with a specific cancer antigen. Examples of cancer include, but are not limited to, cancer of the oral cavity and pharynx, the digestive system (e.g., the esophagus, stomach, small intestine, colon, rectum, anus, liver, gall bladder, appendix, bile ducts, and pancreas), or the endocrine system In certain embodiments, the cancer of digestive system is a cancer of the esophagus, stomach, small intestine, colon, rectum, anus, liver, gall bladder, appendix, bile ducts, and pancreas.

As used herein, the term "esophageal cancer" is intended to include the well-accepted medical definition that defines esophageal cancer as a medical condition characterized by cancer of cells of the esophagus. Examples of esophageal cancer include adenocarcinoma, squamous cell carcinoma, choriocarcinoma, lymphoma, sarcoma, and small cell cancer.

"Gastrointestinal" (GI) cancer is a term for the group of cancers that affect the digestive system. As used herein, the term "stomach cancer" or "gastric cancer" is intended to include the well-accepted medical definition that defines stomach cancer as a medical condition characterized by cancer of cells of the stomach. In particular, stomach cancer or gastric cancer is a disease in which malignant cells form in the lining of the stomach. Stomach or gastric cancer can develop in any part of the stomach and may spread throughout the stomach and to other organs; particularly the esophagus, lungs and the liver.

As used herein, the term "colorectal cancer" or "bowel cancer", is intended to include the well-accepted medical definition that defines colorectal cancer as a medical condition characterized by cancer of cells of the intestinal tract below the small intestine (i.e., the large intestine (colon), including the cecum, ascending colon, transverse colon, descending colon, and sigmoid colon, and rectum). Additionally, as used herein, the term "colorectal cancer" is meant to further include medical conditions which are characterized by cancer of cells of the duodenum and small intestine (jejunum and ileum). The definition of colorectal cancer used herein is more expansive than the common medical definition but is provided as such since the cells of the duodenum and small intestine also contain GUCY2c.

As used herein, the term "malignant cell", or "malignancy" refers to tumors or tumor cells that are invasive and/or able to undergo metastasis, i.e., a cancerous cell.

As used herein, the term "treat," "treating" or "treatment" is an approach for obtaining beneficial or desired clinical results. For the purpose of the present invention, treatment is defined as the administration of a GUCY2c antibody molecule (e.g., GUCY2c monoclonal antibody or GUCY2c bispecific or multispecific antibody) to a subject, e.g., a patient. Such administration can be e.g., by direct administration to the subject or by application to an isolated tissue or cell from a subject which is returned to the subject. The GUCY2c antibody molecule can be administered alone or in combination with one or more agents. The treatment can be to cure, heal, alleviate, relieve, alter, remedy, ameliorate, palliate, improve or affect the disorder, the symptoms of the disorder or the predisposition toward the disorder, e.g., a cancer. In some embodiments, the treatment is useful in any one or more of the following: (a) treating, preventing, or ameliorating one or more symptoms of a condition associated with malignant cells expressing GUCY2c in a subject (e.g., gastrointestinal-related cancer such as colorectal cancer (CRC)); (b) inhibiting tumor growth or progression in a subject who has a malignant tumor expressing GUCY2c; (c) inhibiting metastasis of cancer (malignant) cells expressing GUCY2c in a subject who has one or more malignant cells expressing GUCY2c; (d) inducing regression (e.g., long-term regression) of a tumor expressing GUCY2c; (e) exerting cytotoxic activity in malignant cells expressing GUCY2c; (f) increasing the progression-free survival of a subject with a GUCY2c associated disorder; (g) increasing the overall survival of a subject with a GUCY2c associated disorder; (h) reducing use of additional chemotherapeutic or cytotoxic agents in a subject with a GUCY2c associated disorder; (i) reducing the tumor burden in a subject with a GUCY2c associated disorder; or (j) blocking GUCY2c interaction with other yet to be identified factors. While not wishing to be bound by theory, treating is believed to cause the inhibition, ablation, or killing of a cell in vitro or in vivo, or otherwise reducing the capacity of a cell, including an aberrant cell, to mediate a disorder, e.g., a disorder as described herein such as cancer.

An "antidiarrheal agent" as used herein means a medicine that stops or slows diarrhea. In addition to supportive care that may include fluid administration along with stopping lactose, alcohol, high osmolar products, these antidiarrheals may be co-administered or in combination with GUCY2c bispecifics. Antidiarrheal agents include, but are not limited to, bismuth subgallate, *Lactobacillus acidophilus, Saccharomyces boulardii*, loperamide/simethicone, atropine/diphenoxylate, atropine/difenoxin, *Saccharomyces boulardii* lyo, *Lactobacillus acidophilus*, loperamide, bismuth subsalicylate, *Lactobacillus acidophilus/Lactobacillus bulgaricus, Lactobacillus rhamnosus*, attapulgite, crofelemer, fluoroquinolone, antibiotic or octreotide. See Bensen et al. Recommended Guidelines for the Treatment of Cancer Treatment-Induced Diarrhea. Journal of Clinical Oncology 14: 2918-2926, 2004.

As used herein, the term "subject" is intended to include any animal (e.g., a mammal), including, but not limited to, humans, non-human primates, rodents, and the like, which is to be the recipient of a particular treatment. For example, a subject can be a patient (e.g., a human patient or a veterinary patient), having a cancer. Typically, the terms "subject," "individual" and "patient" are used interchangeably herein in reference to a human subject.

The term "non-human animals" of the invention includes all non-human vertebrates, e.g., non-human mammals and non-mammals, such as non-human primates, sheep, dog, cow, chickens, amphibians, reptiles, mouse, rat, rabbit or goat etc., unless otherwise noted.

As used herein, the term "pharmaceutically acceptable" refers to a product or compound approved (or approvable) by a regulatory agency of the Federal government or a state government or listed in the U.S. Pharmacopeia or other generally recognized pharmacopeia for use in animals, including humans.

As used herein, the terms "pharmaceutically acceptable excipient, carrier or adjuvant" or "acceptable pharmaceutical carrier" refer to an excipient, carrier or adjuvant that can be administered to a subject, together with at least one antibody of the present disclosure, and which does not destroy the activity of the antibody. The excipient, carrier or adjuvant should be nontoxic when administered with an antibody in doses sufficient to deliver a therapeutic effect.

As used herein, the term "ameliorating" means a lessening or improvement of one or more symptoms as compared to not administering an antibody molecule of the invention. "Ameliorating" also includes shortening or reduction in duration of a symptom.

As used herein, the terms "prevent", "preventing" and "prevention" refer to the prevention of the recurrence or onset of one or more symptoms of a disorder in a subject as result of the administration of a prophylactic or therapeutic agent.

As used herein, an "effective amount," "therapeutically effective amount," "therapeutically sufficient amount," or "effective dosage" refers to any amount of a therapeutic agent which is effective or sufficient, upon single or multiple dose administration to a subject, in preventing, healing, ameliorating, treating or managing a disease, disorder or side effect, or decreasing the rate of advancement of a disease or disorder, or in prolonging curing, alleviating, relieving, or improving the condition of a subject with a disorder as described herein beyond that expected in the absence of such treatment. The term also includes within its scope amounts effective to enhance normal physiological function. An effective amount may be considered in the context of administering one or more therapeutic agents, and a single agent may be considered to be given in an effective amount if, in conjunction with one or more other agents, a desirable result may be or is achieved.

As used herein, "inhibiting the growth" of the tumor or cancer refers to slowing, interrupting, arresting or stopping its growth and/or metastases and does not necessarily indicate a total elimination of the tumor growth.

Potency is a measure of the activity of a therapeutic agent expressed in terms of the amount required to produce an effect of given intensity. A highly potent agent evokes a greater response at low concentrations compared to an agent of lower potency that evokes a smaller response at low concentrations. Potency is a function of affinity and efficacy. Efficacy refers to the ability of therapeutic agent to produce a biological response upon binding to a target ligand and the quantitative magnitude of this response. As used herein, the term "half maximal effective concentration ($EC_{50}$)" refers to the concentration of a therapeutic agent which causes a response halfway between the baseline and maximum after a specified exposure time. The therapeutic agent may cause inhibition or stimulation. The $EC_{50}$ value is commonly used, and is used herein, as a measure of potency.

As used herein, "combination therapy" or administration "in combination with" refers to the use of more than one prophylactic and/or therapeutic agent. The use of the term "combination therapy" or "in combination" does not restrict the order in which prophylactic and/or therapeutic agents are administered to a subject with a disorder. In other words, the combination therapy may be done by separately, sequentially, or simultaneously treating with the therapeutic agents. In the case of "sequential administration," the first administered agent may be exerting some physiological effect on the subject when the second agent is administered or becomes active in the subject.

The term "simultaneous administration" as used herein in relation to the administration of prophylactic and/or therapeutic agent refers to the administration of agents such that the individual agents are present within a subject at the same time. Simultaneous administration may be affected by the molecules being formulated in a single composition, or in separate compositions administered at the same or similar time. Sequential administration may be in any order as required.

As used herein, "GUCY2c," refers to mammalian guanylyl cyclase C (GUCY2c), preferably human GUCY2c protein. The term "GUCY2c" may be used interchangeably with the term "GUCY2C". A nucleotide sequence for human GUCY2c is disclosed as GenBank Accession No.: NM.sub.-004963, which is incorporated herein by reference. The amino acid sequence for human GUCY2c is disclosed as GenBank Accession No. NP.sub.-004954, which is incorporated herein by reference.

Typically, a naturally occurring allelic variant has an amino acid sequence at least 95%, 97% or 99% identical to the protein described in GenBank Accession No. NP.sub.-004954. The GUCY2c protein is characterized as a transmembrane cell surface receptor protein, and is believed to play a critical role in the maintenance of intestinal fluid, electrolyte homeostasis and cell proliferation.

As used herein, an "antibody that binds to GUCY2c," an "antibody that recognizes GUCY2c," an "anti-GUCY2c antibody," an "anti-GUCY2c antibody molecule" or a "GUCY2c antibody" comprises a molecule which combines at least one binding domain of an antibody (as herein defined) with at least one binding domain of an anti-GUCY2c antibody (as defined in this application). The GUCY2c antibody molecule of the present invention includes antibodies and antigen-binding fragrments thereof that interact with or recognize, e.g., bind (e.g., bind specifically) to GUCY2c, e.g., human GUCY2c, mouse GUCY2c, rat GUCY2c, cynomolgus GUCY2c.

The term "Cluster of differentiation 3" or "CD3" refers a multimeric protein complex, known historically as the T3 complex, and is composed of four distinct polypeptide chains; epsilon (ε), gamma (γ), delta (δ) and zeta (ζ) that assemble and function as three pairs of dimers (εγ, εδ, ζζ). The CD3 complex serves as a T cell co-receptor that associates noncovalently with the T cell receptor (TCR) (Smith-Garvin et al. 2009) and generate an activation signal in T lymphocytes. The CD3 protein complex is a defining feature of the T cell lineage, therefore CD3 antibodies can be used effectively as T cell markers markers (Chetty and Gatter, Journal of Pathology, Vol 172, 4, 303-301 (1994)). It is well known that CD3 antibodies elicit the generation of cytotoxic T cells through the activation of endogenous lymphokine production and are capable of selectively killing tumor targets (Yun et al., Cancer Research, 49:4770-4774, 1989).

More specifically, T cells express TCR complexes that are able to induce antigen specific immune responses (Smith-Garvin et al., Annula Review of Immunology, 27:1, 591-619 (2009)). Antigens are peptides expressed by tumor cells and virally infected cells capable of stimulating immune responses. Intracellularly expressed antigens are bound to major histocompatibility class I (MHC class I) molecules and transported to the surface where they are exposed to T cells. If the binding affinity of the TCR to the MHC class I in complex with the antigen is sufficient the formation of an immune synapse will be initiated. Signaling through the immune synapse is mediated through the CD3 co-receptors that form εδ, εγ and ζζ dimers. These dimers associate with the TCR and generate an activation signal in T lymphocytes. This signaling cascade directs T cell mediated killing of the cell expressing the antigen. Cytotoxicity is mediated by release and transfer of granzyme B and perforin from the T cell to the target cell.

As used herein, an "antibody that binds to CD3", an "antibody that recognizes CD3", an "anti-CD3 antibody", a "CD3 antibody molecule" or a "CD3 antibody" includes antibodies and antigen-binding fragments thereof that specifically recognize a single CD3 subunit (e.g., epsilon, delta, gamma or zeta), as well as antibodies and antigen-binding fragments thereof that specifically recognize a dimeric complex of two CD3 subunits (e.g., gamma/epsilon, delta/epsilon, and zeta/zeta CD3 dimers). The human CD3 epsilon is indicated in Gen Bank Accession No. NM_000733. The antibodies and antigen-binding fragments of the present invention may bind soluble CD3 and/or cell surface expressed CD3. Soluble CD3 includes natural CD3 proteins as well as recombinant CD3 protein variants such as, e.g., monomeric and dimeric CD3 constructs, that lack a transmembrane domain or are otherwise unassociated with a cell membrane.

Antibodies directed against CD3 are able to generate an activation signal in T lymphocytes. Other T cell activation ligands can be used as well, including without limitation CD28, CD134, CD137, and CD27.

CD3 bispecific antibodies circumvent the need for MHC-peptide/TCR engagement, and instead recruit T cells to target cells expressing cell surface antigen. One arm of the bispecific binds to a tumor associate cell surface antigen, and the other arm binds to the CD3 protein, which is a part of the TCR complex on T cells. Co-engagement of CD3 on T cells and target antigen on tumor cells via a bispecific antibody leads to a cytotoxic response. Accordingly, without being bound by theory, it is believed that the bispecific antibodies of the present invention may allow the T cell to circumvent the need for the interaction of the TCR and MHC class I in complex with antigen, and instead redirects T cells to target cells through direct co-engagement of CD3 (such as CD3 epsilon) expressed on the T cell and GUCY2c expressed on the tumor.

As used herein, the term "CD3-GUCY2c bispecific antibody" refers to a molecule designed to harness a subject's T cells to kill cancer cells by targeting to the tumor cells expressing a desired molecule. In certain embodiments, the desired molecule is human GUCY2c. In some embodiments, the CD3-GUCY2c bispecific antibody comprises two Fv domains. In some embodiments, the CD3-GUCY2c bispecific antibody comprises a first Fv domain directed to GUCY2c and a second Fv domain directed to CD3. The Fv domains may be scFv domains.

As used herein, the "first polypeptide" is any polypeptide which is to be associated with a second polypeptide. The first polypeptide and second polypeptide meet at an interface. In addition to the interface, the first polypeptide may comprise one or more additional domains, such as "binding domains" (e.g., an antibody variable domain, receptor binding domain, ligand binding domain or enzymatic domain) or antibody constant domains (or parts thereof) including CH2, CH1 and CL domains. Normally, the first polypeptide will comprise at least one domain which is derived from an antibody. This domain conveniently is a constant domain, such as the CH3 domain of an antibody and can form the interface of the first polypeptide. Exemplary first polypeptides include antibody heavy chain polypeptides, chimeras combining an antibody constant domain with a binding domain of a heterologous polypeptide, receptor polypeptides, ligand polypeptides, and antibody variable domain polypeptides (e.g., bispecific antibodies).

In addition to the interface, the second polypeptide may comprise additional domains such as a "binding domain" (e.g., an antibody variable domain, receptor binding domain, ligand binding domain or enzymatic domain), or antibody constant domains (or parts thereof) including CH2, CH1 and CL domains. Normally, the second polypeptide will comprise at least one domain which is derived from an antibody. This domain conveniently is a constant region, such as the CH3 domain of an antibody and can form the interface of the second polypeptide. Exemplary second polypeptides include antibody heavy chain polypeptides, chimeras combining an antibody constant domain with a binding domain of a heterologous polypeptide, and antibody variable domain polypeptides (e.g., bispecific antibodies).

As used herein, the term "complex" or "complexed" refers to the association of two or more molecules that interact with each other through bonds and/or forces (e.g., van der waals, hydrophobic, hydrophilic forces) that are not peptide bonds. In one embodiment, the complex is heteromultimeric. It should be understood that the term "protein complex" or "polypeptide complex" as used herein includes complexes that have a non-protein entity conjugated to a protein in the protein complex (e.g., including, but not limited to, chemical molecules such as a toxin or a detection agent).

Although any materials and methods similar or equivalent to those described herein can be used in the practice or testing or testing of the present invention, the preferred materials and methods are now described.

Materials and Methods

Various techniques for the production of antibodies have been described which include the traditional hybridoma method for making monoclonal antibodies, recombinant techniques for making antibodies (including chimeric antibodies, e.g., humanized antibodies), antibody production in transgenic animals and the recently described phage display technology for preparing "fully human" antibodies. These techniques are described briefly below.

Polyclonal antibodies to the antigen of interest generally can be raised in animals by multiple subcutaneous (sc) or intraperitoneal (ip) injections of the antigen and an adjuvant. The antigen (or a fragment containing the target amino acid sequence) can be conjugated to a protein that is immunogenic in the species to be immunized, e.g., serum albumin, bovine thyroglobulin, or soybean trypsin inhibitor using a bifunctional or derivatizing agent, for example maleimidobenzoyl sulfosuccinimide ester (conjugation through cysteine residues), or N-hydroxysuccinimide (through lysine residues). Animals are immunized against the immunogenic conjugates or derivatives and a few weeks later the animals are boosted by subcutaneous injection at multiple sites. 7 to 14 days later the animals are bled and the serum is assayed for antibody titer. Animals are boosted until the titer plateaus. Preferably, the animal is boosted with the conjugate of the same antigen, but conjugated to a different protein and/or through a different cross-linking reagent. Conjugates also can be made in recombinant cell culture as protein fusions. Also, aggregating agents such as alum are used to enhance the immune response.

Monoclonal antibodies can be obtained from a population of substantially homogeneous antibodies using the hybridoma method first described by Kohler & Milstein, Nature 256:495, 1975 or may be made by recombinant DNA methods (Cabilly et al., U.S. Pat. No. 4,816,567). In the hybridoma method, a mouse or other appropriate host animal is immunized as hereinabove described to elicit lymphocytes that produce, or are capable of producing, antibodies that will specifically bind to the protein used for immunization. Alternatively, lymphocytes may be immunized in vitro. Lymphocytes then are fused with myeloma cells using a suitable fusing agent, such as polyethylene glycol, to form a hybridoma cell (Goding, Monoclonal Antibodies: Principles and Practice, pp. 59-103 (Academic Press, 1986). The hybridoma cells thus prepared are seeded and grown in a suitable culture medium that preferably contains one or more substances that inhibit the growth or survival of the unfused, parental myeloma cells. In addition, the hybridoma cells may be grown in vivo as ascites tumors in an animal. The monoclonal antibodies secreted by the subclones are suitably separated from the culture medium, ascites fluid, or serum by conventional immunoglobulin purification procedures such as, for example, Protein A-Sepharose, hydroxylapatite chromatography, gel electrophoresis, dialysis, or affinity chromatography.

The expression of antibody, antigen-binding fragments of an antibody, or any antibody construct can be performed in appropriate prokaryotic or eukaryotic host cells like CHO cells, NSO cells, SP2/0 cells, HEK293 cells, COS cells, PER.C6 cells, yeast, or *E. coli* cells, and the secreted antibody is recovered and harvested from the cells (a cell culture supernatant, a conditioned cell culture supernatant, a cell lysate, or a clarified bulk.). General methods for production of antibodies are well-known in the state of the art and described, for example, in the review articles of Makrides, S.C., Protein Expr. Purif. 17:183-202, 1999; Geisse, S., et al., Protein Expr. Purif. 8:271-282, 1986; Kaufman, R. J., Mol. Biotechnol. 16:151-160, 2000; Werner, R. G., Drug Res. 48:870-880, 1998. In a specific embodiment, the cell culture is a mammalian cell culture, such as a Chinese Hamster Ovary (CHO) cell culture.

In various embodiments, the isolated or recovered antibodies can be subjected to additional purification steps by using conventional chromatography methods known in the art. In particular, methods of purification are contemplated to include, but are not limited to, affinity chromatography (e.g., a Protein A affinity chromatography), ion-exchange chromatography (e.g., an anion exchange chromatography or a cation exchange chromatography), hydrophobic interaction chromatography, hydroxylapatite chromatography, gel filtration chromatography and/or dialysis. Among those, a preferred purification method is using Protein A chromatography. The matrix to which the affinity ligand is attached is most often agarose, but other matrices are available.

Other techniques for antibody purification such as fractionation on an ion-exchange column, ethanol precipitation, reverse phase high pressure chromatography, ethanol precipitation, Reverse Phase HPLC, chromatography on silica, chromatography on heparin Sepharose™, chromatography on an anion or cation exchange resin (such as a polyaspartic acid column), chromatofocusing, electrophoresis using SDS-PAGE, and ammonium sulfate precipitation are also known in the art. The above list of purification methods is merely exemplary in nature, and is not intended to be a limiting recitation.

Alternatively, it is possible to produce transgenic animals (e.g., mice) that are capable, upon immunization, of producing a full repertoire of human antibodies in the absence of endogenous immunoglobulin production. For example, it has been described that the homozygous deletion of the antibody heavy chain joining region (J.sub.H) gene in chimeric and germ-line mutant mice results in complete inhibition of endogenous antibody production. Transfer of the human germ-line immunoglobulin gene array in such germ-line mutant mice will result in the production of human antibodies upon antigen challenge. See, e.g., Jakobovits et al., Proc. Natl. Acad. Sci. USA 90:2551-255; 1993 and Jakobovits et al., Nature 362:255-258, 1993).

In some embodiments, the antibodies of the present invention can be humanized with retention of high affinity for the antigen and other favorable biological properties. Methods for humanizing non-human antibodies are well known in the art. Humanization can be essentially performed following the method of Winter and co-workers (Jones et al., Nature 321:522-525, 1986; Riechmann et al., Nature 332:323-327, 1988; Verhoeyen et al., Science 239: 1534-1536, 1988), by substituting rodent CDRs or CDR sequences for the corresponding sequences of a human antibody. Accordingly, such humanized antibodies are chimeric antibodies (Cabilly, supra), wherein substantially less than an intact human variable domain has been substituted by the corresponding sequence from a non-human species. In practice, humanized antibodies are typically human antibodies in which some CDR residues, and possibly some FR residues, are substituted by residues from analogous sites in rodent antibodies. It is important that antibodies be humanized with retention of high affinity for the antigen and other favorable biological properties. To achieve this goal, according to a preferred method, humanized antibodies are prepared by a process of analysis of the parental sequences and various conceptual humanized products using three dimensional models of the parental and humanized sequences. Three dimensional immunoglobulin models are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the consensus and import sequence so that the desired antibody characteristic, such as increased affinity for the target antigen(s), is achieved. For further details see WO92/22653, published Dec. 23, 1992.

Antibodies of the present invention can also be generated using various phage display methods known in the art. In phage display methods, functional antibody domains are displayed on the surface of phage particles which carry the polynucleotide sequences encoding them. In a particular aspect, such phage can be utilized to display antigen binding domains, such as Fab and Fv or disulfide-bond stabilized Fv, expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods is typically filamentous phage, including fd and M13. The antigen binding domains are expressed as a recombinantly fused protein to either the phage gene III or gene VIII protein. Examples of phage display methods that can be used to make the immunoglobulins, or fragments thereof, of the present invention include those disclosed in Brinkmann et al. "Phage Display Of Disulfide-Stabilized Fv Fragments," J. Immunol. Methods, 182:41-50, 1995.

The functional characteristics of the multiple IgG isotypes, and domains thereof, are well known in the art. The amino acid sequences of IgG1, IgG2, IgG3 and IgG4 are known in the art. Selection and/or combinations of two or more domains from specific IgG isotypes for use in the methods of the invention may be based on any known parameter of the parent isotypes including affinity to FcγR. For example, use of regions or domains from IgG isotypes that exhibit limited or no binding to FcγRIIB, e.g., IgG2 or IgG4, may find particular use where a bispecific antibody is desired to be engineered to maximize binding to an activating receptor and minimize binding to an inhibitory receptor. Similarly, use of Fc chains or domains from IgG isotypes known to preferentially bind C1q or FcγRIIIA, e.g., IgG3 may be combined with Fc amino acid modifications known in the art to enhance antibody-dependent cell mediated cytotoxicity (ADCC) and/or complement dependent cytotoxicity (CDC), to engineer a bispecific antibody such that effector function activity, e.g., complement activation or ADCC, is maximized. In a similar fashion, mutations may be made in the Fc chains or domains of IgG isotypes that minimize or eliminate the effector function of the Fc chain.

During the discovery process, the generation and characterization of antibodies may elucidate information about desirable epitopes. From this information, it is then possible to competitively screen antibodies for binding to the same epitope. An approach to achieve this is to conduct competition and cross-competition studies to find antibodies that compete or cross-compete with one another e.g., the antibodies compete for binding to the antigen. One method is to identify the epitope to which antibodies bind, or "epitope mapping". There are many methods known in the art for mapping and characterizing the location of epitopes on proteins, including solving the crystal structure of an antibody-antigen complex, competition assays, gene fragment expression assays, and synthetic peptide-based assays, as described, for example, in Chapter 11 of Harlow and Lane, Using Antibodies, a Laboratory Manual, Cold Spring Harbor Laboratory Press, Cold Spring Harbor, N.Y., 1999. In an additional example, epitope mapping can be used to determine the sequence to which an antibody binds. Epitope mapping is commercially available from various sources, for example, Pepscan Systems (Edelhertweg 15, 8219 PH Lelystad, The Netherlands). In an additional example, mutagenesis of an antigen binding domain, domain swapping experiments and alanine scanning mutagenesis can be performed to identify residues required, sufficient, and/or necessary for epitope binding. The binding affinity and the off-rate of an antigen-binding domain interaction can be determined by competitive binding assays. One example of a competitive binding assay is a radioimmunoassay comprising the incubation of labeled antigen, and the detection of the molecule bound to the labeled antigen. The affinity of the molecule of the present invention for an antigen and the binding off-rates can be determined from the saturation data by Scatchard analysis.

The affinities and binding properties of the antibodies of the present invention for an antigen may be initially determined using in vitro assays (biochemical or immunological based assays) known in the art for antigen-binding domain, including but not limited to enzyme-linked immunosorbent assay (ELISA) assay, surface plasmon resonance (SPR) assay, Bio-Layer Interferometry, or immunoprecipitation assays. The molecules of the invention may have similar binding properties in vivo models (such as those described and disclosed herein) as those in in vitro based assays. However, the present invention does not exclude molecules of the invention that do not exhibit the desired phenotype in in vitro based assays but do exhibit the desired phenotype in vivo.

An optional bispecific antibody format is an Fv-derived strategy based on a covalently linked, bispecific heterodimeric diabody structure, also known as dual-affinity re-targeting (DART®) proteins, which is described in for example in U.S. Pat. Publication Nos. 2007/0004909, 2009/0060910, and 2010/0174053).

Once a nucleic acid sequence encoding molecules of the invention (i.e., binding domains) has been obtained, the vector for the production of the molecules may be produced by recombinant DNA technology using techniques well known in the art.

The polynucleotides encoding the antibody (e.g., GUCY2c antibody or CD3-GUCY2c bispecific antibody) binding domains of the present invention may include an expression control polynucleotide sequence operably linked to the antibody coding sequences, including naturally-associated or heterologous promoter regions known in the art. The expression control sequences may be eukaryotic promoter systems in vectors capable of transforming or transfecting eukaryotic host cells, but control sequences for prokaryotic hosts may also be used. Once the vector has been incorporated into the appropriate host cell line, the host cell is propagated under conditions suitable for expressing the nucleotide sequences, and, as desired, for the collection and purification of the antibodies. Eukaryotic cell lines include the CHO cell lines, various COS cell lines, HeLa cells, myeloma cell lines, transformed B-cells, or human embryonic kidney cell lines.

In one embodiment, the DNA encoding the antibodies of the invention is isolated and sequenced using conventional procedures (e.g., by using oligonucleotide probes that are capable of binding specifically to genes encoding the heavy and light chains of murine antibodies). The hybridoma cells of the invention serve as a preferred source of such DNA. Once isolated, the DNA may be placed into expression vectors, which are then transfected into host cells such as simian COS cells, CHO cells, or myeloma cells that do not otherwise produce immunoglobulin protein, to obtain the synthesis of monoclonal antibodies in the recombinant host cells. The DNA also may be modified, for example, by substituting the coding sequence for human heavy and light chain constant domains in place of the homologous murine sequences, Morrison et al., Proc. Nat. Acad. Sci. 81:6851, 1984. In that manner, chimeric antibodies are prepared that have the binding specificity of an anti-antigen monoclonal antibody herein.

As a cell surface protein, GUCY2c can serve as a therapeutic target for receptor binding proteins such as antibodies or ligands. In normal intestinal tissue, GUCY2c is expressed on the apical side of epithelial cell tight junctions that form a barrier between the luminal environment and vascular compartment (Almenoff et al., Mol Microbiol 8: 865-873, 1993; and Guarino et al., Dig Dis Sci 32: 1017-1026, 1987).

As such, systemic intravenous administration of a GUCY2c-binding protein therapeutic will have minimal effect on intestinal GUCY2c receptors present on normal cells, while having access to neoplastic cells of the gastrointestinal system, including malignant or metastatic colon cancer cells, extraintestinal or metastatic colon tumors, esophageal tumors or stomach tumors, or adenocarcinoma at the gastroesophageal junction. Additionally, GUCY2c internalizes through receptor mediated endocytosis upon ligand binding (Buc et al. Eur J Cancer 41: 1618-1627, 2005; Urbanski et al., Biochem Biophys Acta 1245: 29-36, 1995).

The tissue-specific expression and association of GUCY2c with cancer, e.g., of gastrointestinal origin, (e.g., colon cancer, stomach cancer, or esophageal cancer), can be exploited to permit the use of GUCY2c as a diagnostic marker for this disease (Carrithers et al., Dis Colon Rectum 39:171-181, 1996; Buc et al. Eur J Cancer 41: 1618-1627, 2005).

The present invention provides an antibody that binds to GUCY2c (e.g., human GUCY2c (e.g., SEQ ID NO: 224 which is a derivative of accession number: NP_004954.2)) and is useful in any one or more of the following: (a) treating, preventing, or ameliorating one or more symptoms of a condition associated with malignant cells expressing GUCY2c in a subject (e.g., gastrointestinal-related cancer such as colorectal cancer (CRC)); (b) inhibiting tumor growth or progression in a subject who has a malignant tumor expressing GUCY2c; (c) inhibiting metastasis of cancer (malignant) cells expressing GUCY2c in a subject who has one or more malignant cells expressing GUCY2c; (d) inducing regression (e.g., long-term regression) of a tumor expressing GUCY2c; (e) exerting cytotoxic activity in malignant cells expressing GUCY2c; (f) increasing the progression-free survival of a subject with a GUCY2c associated disorder; (g) increasing the overall survival of a subject with a GUCY2c associated disorder; (h) reducing use of additional chemotherapeutic or cytotoxic agents in a subject with a GUCY2c associated disorder; (i) reducing the tumor burden in a subject with a GUCY2c associated disorder; or (j) blocking GUCY2c interaction with other yet to be identified factors.

In one aspect, provided is an antibody comprising (a) a heavy chain variable (VH) region comprising a VH complementarity determining region one (VH CDR1), a VH complementarity determining region two (VH CDR2), and a VH complementarity determining region three (VH CDR3) of the VH sequence shown in SEQ ID NO: 11, 19, 26, 33, 41, 48, 52, 57, 60, 62, 64, 65, 67, 69, 71, or 73; and/or (b) a light chain variable (VL) region comprising a VL complementarity determining region one (VL CDR1), a VL complementarity determining region two (VL CDR2), and a VL complementarity determining region three (VL CDR3) of the VL sequence shown in SEQ ID NO: 92, 100, 104, 106, 112, 119, 125, 129, 134, 136, 137, 138, 140, 143, 145, 147, 150, 152, 156, 158, 160, 162, 166, 170, 171, 172, 173, 174, or 175.

In another aspect, provided is an antibody having any one of partial heavy chain sequence and/or any one of partial light chain sequence as listed in Table 1. In one embodiment, the invention provides an antibody comprising a VH region and/or a VL region, wherein: (a) the VH region comprises SEQ ID NO: 11, 19, 26, 33, 41, 48, 52, 57, 60, 62, 64, 65, 67, 69, 71, or 73; and/or (b) the VL region comprises SEQ ID NO: 92, 100, 104, 106, 112, 119, 125, 129, 134, 136, 137, 138, 140, 143, 145, 147, 150, 152, 156, 158, 160, 162, 166, 170, 171, 172, 173, 174, or 175.

TABLE 1

| Description | Sequence |
|---|---|
| GUCY2C-0074_VH | EVQLQQSGAELARPGASVNLSCKASGYTFTTYWMQWVK QRPGQGLEWIGA<u>IYPGDGMTTYTQKFKD</u>KATLTADKSSST AYMQLSSLASEDSAVYYCVR<u>KGMDY</u>WGQGTSVTVSS<br>(SEQ ID NO: 11) |
| GUCY2C-0077_VH | EVQLQQSGAELARPGASVKLSCKASGYTFTKYWMQWIKQ RPGQGLEWIGA<u>IYPGDGFTTYTQKFKG</u>KATLTADKSSNTA YMQLSSLASEDSAVYYCARR<u>NYGRTYGGDY</u>WGQGTSVT VSS<br>(SEQ ID NO: 19) |
| GUCY2C-0098_VH | QVQLQQPGAELVKPGASVKLSCKASGYTFTSYWMHWVK QRPGQGLEWIGE<u>IKPSNGLTNYIEKFKN</u>KATLTVDKSATTA YMQLSSLTAEDSAVYYCTR<u>TITTTEGYWFFDV</u>WGAGTTVT VSS<br>(SEQ ID NO: 26) |
| GUCY2C-0104_VH | EVQLQQSGAELVKPGASVKLSCTASGFNIKDTYIHWVQR PEQGLEWIGR<u>IDPANGNANYDPKFQG</u>KATITADTSSNTAYL QLSSLTSEDTAVFYCSS<u>LGTGTY</u>WGQGTTLTVSS<br>(SEQ ID NO: 33) |
| GUCY2C-0105_VH | EVQLQQSGPELVKPGASVKISCKASGYSFTDYIMLWVKQS HGKSLEWIGN<u>SNPYYGSTSYNLKFKG</u>KATLTVDKSSSTAY MHLNSLTSEDSAVYYCAR<u>SGYYGSSPYWYFDV</u>WGAGTTV TVSS<br>(SEQ ID NO: 41) |
| GUCY2C-0240_VH | EVQLVESGGGLVQPGGSLRLSCAASGYTFTTYWMQWVR QAPGKGLEWIGA<u>IYPGDGMTTYTQKFKD</u>RFTISADKAKNS AYLQMNSLRAEDTAVYYCVR<u>KGMDY</u>WGQGTLVTVSS<br>(SEQ ID NO: 48) |
| GUCY2C-0315_VH | QVQLVQSGAEVKKPGASVKVSCKASGYTFTTYWMQWVR QAPGQGLEWIGA<u>IYPGDGMTTYTQKFQG</u>RVTMTRDTSTST VYMELSSLRSEDTAVYYCVR<u>KGMDY</u>WGQGTLVTVSS<br>(SEQ ID NO: 52) |
| GUCY2C-0179_VH | EVQLVESGGGLVQPGGSLRLSCAASGYSFTDYIMLWVRQ APGKGLEWIGNSNPYYGSTSYNLKFKGRFTISVDKAKNSA YLQMNSLRAEDTAVYYCAR<u>SGYYGSSPYWYFDV</u>WGQGT MVTVSS<br>(SEQ ID NO: 57) |
| GUCY2C-0193_VH | EVQLVESGGGLVQPGGSLRLSCAASGYTFTSYWMHWVR QAPGKGLEWIGE<u>IKPSNGLTNYIEKFKN</u>RFTISVDKAKNSA YLQMNSLRAEDTAVYYCTR<u>TITTTEGYWFFDV</u>WGQGTLVT VSS<br>(SEQ ID NO: 60) |
| GUCY2C-0210_VH | EVQLVESGGGLVQPGGSLRLSCAASGYTFTSYWMHWVR QAPGKGLEWIAE<u>IKPSNGLTNYIEKFKN</u>RFTISRDNAKNSLY LQMNSLRAEDTAVYYCAR<u>TITTTEGYWFFDV</u>WGQGTLVTV SS<br>(SEQ ID NO: 62) |
| GUCY2C-0212_VH | EVQLVESGGGLVQPGGSLRLSCAASGYTFTSYWMHWVR QAPGKGLEWIGE<u>IKPSNGLTNYIEKFKN</u>RFTISRDNAKNSL YLQMNSLRAEDTAVYYCAR<u>TITTTEGYWFFDV</u>WGQGTLVT VSS<br>(SEQ ID NO: 64) |
| GUCY2C-1186_VH | EVQLVESGGGLVQPGGSLRLSCAASGYTFTSYWMHWVR QAPGKGLEWIGE<u>IKPSNGLTNIHPKFKN</u>RFTISVDKAKNSA YLQMNSLRAEDTAVYYCTR<u>TITTTEGYWFFDV</u>WGQGTLVT VSS<br>(SEQ ID NO: 65) |
| GUCY2C-1476_VH | EVQLVESGGGLVQPGGSLRLSCAASGYTFTSYWMHWVR QAPGKGLEWIGE<u>IKPSNGLTNVHEKFKN</u>RFTISVDKAKNSA YLQMNSLRAEDTAVYYCTR<u>TITTTEGYWFFDV</u>WGQGTLVT VSS<br>(SEQ ID NO: 67) |

TABLE 1-continued

| Description | Sequence |
|---|---|
| GUCY2C-1478_VH | EVQLVESGGGLVQPGGSLRLSCAASGYTFTSYWMHWVR QAPGKGLEWIGE<u>IKPSNGLT</u>NVHEKF<u>K</u>NRFTISVDKAKNSA YLQMNSLRAEDTAVYYCTR<u>TITTTEGYWFF</u>DVWGQGTLVT VSS<br>(SEQ ID NO: 69) |
| GUCY2C-1512_VH | EVQLVESGGGLVQPGGSLRLSCAASGYTFTSYWMHWVR QAPGKGLEWIGE<u>IKPSNGLT</u>NYAEQF<u>K</u>NRFTISVDKAKNSA YLQMNSLRAEDTAVYYCTR<u>TITTTEGYWFF</u>DVWGQGTLVT VSS<br>(SEQ ID NO: 71) |
| GUCY2C-1554_VH;<br>GUCY2C-1608_VH | EVQLVESGGGLVQPGGSLRLSCAASGFTFSSYWMHWVR QAPGKGLEWIGE<u>IKPSNELT</u>NVHEKF<u>K</u>DRFTISVDKAKNSA YLQMNSLRAEDTAVYYCTR<u>TITTTEGYWFF</u>DVWGQGTLVT VSS<br>(SEQ ID NO: 73) |
| GUCY2C-0074_VL | DIVLTQSPASLAVSLGQRATISC<u>RASESVDNYGISFMN</u>WFQ QKPGQPPKLLIY<u>AASNPGS</u>GVPARFSGSGSGTDFSLNIHPL EEDDTAMFFC<u>QQSKEVPYT</u>FGGGTKLEIK<br>(SEQ ID NO: 92) |
| GUCY2C-0077_VL | DIVLTQSPASLAVSLGQRATISC<u>RASESVDNFDISFMN</u>WFQ QKPGQPPKLLIY<u>AASNQGS</u>GVPARFSGSGSGTDFSLNIHP MEEDDTAMYFC<u>QQSKEVPYT</u>FGGGTKLEIK<br>(SEQ ID NO: 100) |
| GUCY2C-0078_VL | DIVLTQSPASLAVSLGQRATISC<u>RAGESVDNFDISFMN</u>WFQ QKPGQPPKLLIY<u>AASNQGS</u>GVPARFSGSGSGTDFSLNIHP MEEDDTAMYFC<u>QQSKEVPYT</u>FGGGTKLEIK<br>(SEQ ID NO: 104) |
| GUCY2C-0098_VL | DIVLTQSPASLAVSLGQRATISC<u>RASESVDYYGTSLMQ</u>WY QQKPGQPPKLLIY<u>AASNVES</u>GVPARFSGSGSGTDFSLNIH PVEEDDIAMYFC<u>QQTRKVYT</u>FGGGTKLEIK<br>(SEQ ID NO: 106) |
| GUCY2C-0104_VL | DIVMTQSPASLAVSLGQRATISC<u>RASKGVTTSGYSYMH</u>WY QQKPGQPPKLLIY<u>LASNLES</u>GVPARFSGSGSGTDFTLNIHP VEEEDAATYYC<u>QHSREFPLT</u>FGAGTKLELK<br>(SEQ ID NO: 112) |
| GUCY2C-0105_VL | DIVMTQSPSSLAVSVGEKVTVSC<u>KSSQSLLYSSNQKNYLA</u> WYQQRPGQSPKLLIY<u>WASTRES</u>GVPDRFTGSGSGTDFTL SISSVKAEDLAVYYC<u>QQYYSYPT</u>FGGGTKLEIK<br>(SEQ ID NO: 119) |
| GUCY2C-0240_VL | DIQLTQSPSSLSASVGDRVTITC<u>RASESVDNYGISFMN</u>WFQ QKPGKAPKLLIY<u>AASNPGS</u>GVPSRFSGSGSGTDFTLTISSL QPEDFATYYC<u>QQSKEVPYT</u>FGQGTKLEIK<br>(SEQ ID NO: 125) |
| GUCY2C-0315_VL | EIVLTQSPATLSLSPGERATLSC<u>RASESVDNYGISFMN</u>WYQ QKPGQAPRLLIY<u>AASNPGS</u>GIPARFSGSGSGTDFTLTISSL EPEDFAVYYC<u>QQSKEVPYT</u>FGQGTKVEIK<br>(SEQ ID NO: 129) |
| GUCY2C-0179_VL | DIQMTQSPSSLSASVGDRVTITC<u>KSSQSLLYSSNQKNYLA</u> WYQQKPGKSPKLLIY<u>WASTRES</u>GVPSRFSGSGSGTDFTLT ISSLQPEDFATYYC<u>QQYYSYPT</u>FGGGTKVEIK<br>(SEQ ID NO: 134) |
| GUCY2C-0193_VL | DIQMTQSPSSLSASVGDRVTITC<u>RASESVDYYGTSLMQ</u>WY QQKPGKAPKLLIY<u>AASNVES</u>GVPSRFSGSGSGTDFTLTISS LQPEDFATYYC<u>QQTRKVYT</u>FGQGTKLEIK<br>(SEQ ID NO: 136) |
| GUCY2C-0210_VL | DIQLTQSPSSLSASVGDRVTITC<u>RASESVDYYGTSLMQ</u>WY QQKPGKAPKLLIY<u>AASNVES</u>GVPSRFSGSGSGTDFTLTISS LQPEDFATYYC<u>QQTRKVYT</u>FGQGTKLEIK<br>(SEQ ID NO: 137) |
| GUCY2C-0247_VL | DIQLTQSPSSLSASVGDRVTITC<u>RASESVDYYGTSLMQ</u>WY QQKPGKPPKLLIY<u>AASNVES</u>GVPSRFSGSGSGTDFTLTISS LQPEDFATYYC<u>QQTRKVYT</u>FGQGTKLEIK<br>(SEQ ID NO: 138) |

TABLE 1-continued

| Description | Sequence |
|---|---|
| GUCY2C-1186_VL | DIQLTQSPSSLSASVGDRVTITC<u>RASESVDYYGTSLMQ</u>WY<br>QQKPGKAPKLLIY<u>AASKRYS</u>GVPSRFSGSGSGTDFTLTISS<br>LQPEDFATYYC<u>QQTRKAYT</u>FGQGTKLEIK<br>(SEQ ID NO: 140) |
| GUCY2C-1467_VL | DIQLTQSPSSLSASVGDRVTITC<u>RASESVDYYGTSLMQ</u>WY<br>QQKPGKAPKLLIY<u>AASKLWS</u>GVPSRFSGSGSGTDFTLTISS<br>LQPEDFATYYC<u>QQTRKVYT</u>FGQGTKLEIK<br>(SEQ ID NO: 143) |
| GUCY2C-1476_VL | DIQLTQSPSSLSASVGDRVTITC<u>RASESVDYYGTSLMQ</u>WY<br>QQKPGKAPKLLIY<u>AASKVAP</u>GVPSRFSGSGSGTDFTLTISS<br>LQPEDFATYYC<u>QQTRKAYT</u>FGQGTKLEIK<br>(SEQ ID NO: 145) |
| GUCY2C-1478_VL;<br>GUCY2C-1608_VL | DIQLTQSPSSLSASVGDRVTITC<u>RASESVDYYGSSLLQ</u>WY<br>QQKPGKAPKLLIY<u>AASKLAS</u>GVPSRFSGSGSGTDFTLTISS<br>LQPEDFATYYC<u>QQTRKAYT</u>FGQGTKLEIK<br>(SEQ ID NO: 147) |
| GUCY2C-1481_VL | DIQLTQSPSSLSASVGDRVTITC<u>RASESVDYYGTSLMQ</u>WY<br>QQKPGKAPKLLIY<u>AASNIAP</u>GVPSRFSGSGSGTDFTLTISSL<br>QPEDFATYYC<u>QQTRKAYT</u>FGQGTKLEIK<br>(SEQ ID NO: 150) |
| GUCY2C-1512_VL | DIQLTQSPSSLSASVGDRVTITC<u>RASESVDYYGSSLMQ</u>WY<br>QQKPGKAPKLLIY<u>AASKRYS</u>GVPSRFSGSGSGTDFTLTISS<br>LQPEDFATYYC<u>QQTRKEYT</u>FGQGTKLKIK<br>(SEQ ID NO: 152) |
| GUCY2C-1518_VL | DIQLTQSPSSLSASVGDRVTITC<u>RASESVDYYGSSLMQ</u>WY<br>QQKPGKAPKLLIY<u>AASNVAP</u>GVPSRFSGSGSGTDFTLTISS<br>LQPEDFATYYC<u>QQTRKAYT</u>FGQGTKLEIK<br>(SEQ ID NO: 156) |
| GUCY2C-1526_VL | DIQLTQSPSSLSASVGDRVTITC<u>RASESVDYYGSSLMQ</u>WY<br>QQKPGKAPKLLIY<u>AASHRAS</u>GVPSRFSGSGSGTDFTLTISS<br>LQPEDFATYYC<u>QQTRKAYT</u>FGQGTKLEIK<br>(SEQ ID NO: 158) |
| GUCY2C-1527_VL | DIQLTQSPSSLSASVGDRVTITC<u>RASESVDYYGTSLMQ</u>WY<br>QQKPGKAPKLLIY<u>AASNVAS</u>GVPSRFSGSGSGTDFTLTISS<br>LQPEDFATYYC<u>QQTRKEYT</u>FGQGTKLEIK<br>(SEQ ID NO: 160) |
| GUCY2C-1538_VL | DIQLTQSPSSLSASVGDRVTITC<u>RASESVDYYGHSLMQ</u>WY<br>QQKPGKAPKLLIY<u>AASNRYS</u>GVPSRFSGSGSGTDFTLTISS<br>LQPEDFATYYC<u>QQTRKAYS</u>FGQGTKLEIK<br>(SEQ ID NO: 162) |
| GUCY2C-1554_VL | DIQMTQSPSSLSASVGDRVTITC<u>RASQSVDYYGSSLLQ</u>WY<br>QQKPGKAPKLLIY<u>DASKLAS</u>GVPSRFSGSGSGTDFTLTISS<br>LQPEDFATYYC<u>QQERKAYT</u>FGQGTKLEIK<br>(SEQ ID NO: 166) |
| GUCY2C-1555_VL | DIQMTQSPSSLSASVGDRVTITC<u>RASQSVDYYGSSLLQ</u>WY<br>QQKPGKAPKLLIY<u>AASKLAS</u>GVPSRFSGSGSGTDFTLTISS<br>LQPEDFATYYC<u>QQERKAYT</u>FGQGTKLEIK<br>(SEQ ID NO: 170) |
| GUCY2C-1556_VL | DIQMTQSPSSLSASVGDRVTITC<u>RASQSVDYYGSSLLQ</u>WY<br>QQKPGKAPKLLIY<u>DASKLAS</u>GVPSRFSGSGSGTDFTLTISS<br>LQPEDFATYYC<u>QQTRKAYT</u>FGQGTKLEIK<br>(SEQ ID NO: 171) |
| GUCY2C-1557_VL | DIQMTQSPSSLSASVGDRVTITC<u>RASQSVDYYGSSLLQ</u>WY<br>QQKPGKAPKLLIY<u>AASKLAS</u>GVPSRFSGSGSGTDFTLTISS<br>LQPEDFATYYC<u>QQTRKAYT</u>FGQGTKLEIK<br>(SEQ ID NO: 172) |
| GUCY2C-1590_VL | DIQLTQSPSSLSASVGDRVTITC<u>RASESVDYYGSSLLQ</u>WY<br>QQKPGKAPKLLIY<u>DASKLAS</u>GVPSRFSGSGSGTDFTLTISS<br>LQPEDFATYYC<u>QQERKAYT</u>FGQGTKLEIK<br>(SEQ ID NO: 173) |

TABLE 1-continued

| Description | Sequence |
| --- | --- |
| GUCY2C-1591_VL | DIQLTQSPSSLSASVGDRVTITC<u>RASESVDYYGSSLLQ</u>WY<br>QQKPGKAPKLLIY<u>AASKLAS</u>GVPSRFSGSGSGTDFTLTISS<br>LQPEDFATYYC<u>QQERKAYT</u>FGQGTKLEIK<br>(SEQ ID NO: 174) |
| GUCY2C-1592_VL | DIQLTQSPSSLSASVGDRVTITC<u>RASESVDYYGSSLLQ</u>WY<br>QQKPGKAPKLLIY<u>DASKLAS</u>GVPSRFSGSGSGTDFTLTISS<br>LQPEDFATYYC<u>QQTRKAYT</u>FGQGTKLEIK<br>(SEQ ID NO: 175) |

In Table 1, the underlined sequences are CDR sequences according to Kabat and in bold according to Chothia. The AbM definition was used for VH CDR1.

The invention also provides CDR portions of antibodies to GUCY2c. CDR contact regions are regions of an antibody that imbue specificity to the antibody for an antigen. In general, CDR contact regions include the residue positions in the CDRs and Vernier zones which are constrained in order to maintain proper loop structure for the antibody to bind a specific antigen. See, e.g., Makabe et al., J. Biol. Chem., 283:1156-1166, 2007. Determination of CDR regions is well within the skill of the art. The algorithm implemented in the version 2.3.3 release of Abysis (www.abysis.org) was used herein to assign Kabat numbering to variable regions, VL CDR1, VL CDR2, VL CDR3, VH CDR2, and VH CDR3, except for VH CDR1. The AbM definition was used for VH CDR1.

In one aspect, provided is an antibody having any one of the VH CDR sequences and/or any one of the VL CDR sequences as listed in Table 2. In one aspect, the invention provides an antibody which specifically binds to guanylyl cyclase C (GUCY2c), wherein the antibody comprises: (a) a heavy chain variable (VH) region comprising (i) a VH complementarity determining region one (VH CDR1) comprising SEQ ID NO: 12, 20, 27, 34, 42, 74, 257, 258, 259, 260, or 261; (ii) a VH complementary determining region two (VH CDR2) comprising SEQ ID NO: 13, 21, 28, 35, 43, 53, 66, 68, 70, 72, 75, 262, 263, 264, 265, 266, or 267; and (iii) a VH complementary determining region three (VH CDR3) comprising SEQ ID NO: 14, 22, 29, 36, or 44; and/or (b) a light chain variable (VL) region comprising (i) a VL complementary determining region one (VL CDR1) comprising SEQ ID NO: 93, 101, 105, 107, 113, 120, 148, 153, 163, or 167; (ii) a VL complementary determining region two (VL CDR2) comprising SEQ ID NO: 78, 94, 102, 108, 114, 141, 144, 146, 149, 151, 157, 159, 161, 164, or 168; and (iii) a VH complementary determining region three (VL CDR3) comprising SEQ ID NO: 95, 109, 115, 121, 142, 154, 165, or 169.

In a specific embodiment, the invention provides an antibody wherein: (a) the VH region comprises (i) a VH CDR1 comprising the sequence of SEQ ID NO: 74 or 259; (ii) a VH CDR2 comprising the sequence of SEQ ID NO: 75 or 267; and iii) a VH CDR3 comprising the sequence of SEQ ID NO: 29; and/or (b) the VL region comprises (i) a VL CDR1 comprising the sequence of SEQ ID NO: 148; (ii) a VL CDR2 comprising the sequence of SEQ ID NO: 149; and (iii) a VL CDR3 comprising the sequence of SEQ ID NO: 142.

TABLE 2

| Heavy Chain | | | |
| --- | --- | --- | --- |
| mAb | VH CDR1 | VH CDR2 | VH CDR3 |
| GUCY2C-0074_VH | GYTFTTYWMQ (SEQ ID NO: 12) (ABM); TYWMQ (SEQ ID NO: 257) (Kabat) | AIYPGDGMTTYTQKFKD (SEQ ID NO: 13) KABAT), YPGDGM (SEQ ID NO: 262) (Chothia) | KGMDY (SEQ ID NO: 14) |
| GUCY2C-0077_VH | GYTFTKYWMQ (SEQ ID NO: 20) (ABM); KYWMQ (SEQ ID NO: 258) (Kabat) | AIYPGDGFTTYTQKFKG (SEQ ID NO: 21) KABAT); YPGDGF (SEQ ID NO: 263) (Chothia) | RNYGRTYGGDY (SEQ ID NO: 22) |
| GUCY2C-0098_VH | GYTFTSYWMH (SEQ ID NO: 27) (ABM); SYWMH (SEQ ID NO: 259) (Kabat) | EIKPSNGLTNYIEKFKN (SEQ ID NO: 28) (KABAT); KPSNGL (SEQ ID NO: 264) (Chothia) | TITTTEGYWFFDV (SEQ ID NO: 29) |
| GUCY2C-0104_VH | GFNIKDTYIH (SEQ ID NO: 34) (ABM); DTYIH (SEQ ID NO: 260) (Kabat) | RIDPANGNANYDPKFQG (SEQ ID NO: 35) (KABAT); DPANGN (SEQ ID NO: 265) (Chothia) | LGTGTY (SEQ ID NO: 36) |

TABLE 2-continued

| | | | |
|---|---|---|---|
| GUCY2C-0105_VH | GYSFTDYIML (SEQ ID NO: 42) (ABM); DYIML (SEQ ID NO: 261) (Kabat) | NSNPYYGSTSYNLKFKG (SEQ ID NO: 43) (KABAT); NPYYGS (SEQ ID NO: 266) (Chothia) | SGYYGSSPYWYFDV (SEQ ID NO: 44) |
| GUCY2C-0240_VH | GYTFTTYWMQ (SEQ ID NO: 12) (ABM); TYWMQ (SEQ ID NO: 257) (Kabat) | AIYPGDGMTTYTQKFKD (SEQ ID NO: 13) (KABAT); YPGDGM (SEQ ID NO: 262) (Chothia) | KGMDY (SEQ ID NO: 14) |
| GUCY2C-0315_VH | GYTFTTYWMQ (SEQ ID NO: 12) (ABM); TYWMQ (SEQ ID NO: 257) (Kabat) | AIYPGDGMTTYTQKFQG (SEQ ID NO: 53) (KABAT); YPGDGM (SEQ ID NO: 262) (Chothia) | KGMDY (SEQ ID NO: 14) |
| GUCY2C-0179_VH | GYSFTDYIML (SEQ ID NO: 42) (ABM); DYIML (SEQ ID NO: 261) (Kabat) | NSNPYYGSTSYNLKFKG (SEQ ID NO: 43) (KABAT); NPYYGS (SEQ ID NO: 266) (Chothia) | SGYYGSSPYWYFDV (SEQ ID NO: 44) |
| GUCY2C-0193_VH | GYTFTSYWMH (SEQ ID NO: 27) (ABM); SYWMH (SEQ ID NO: 259) (Kabat) | EIKPSNGLTNYIEKFKN (SEQ ID NO: 28) (KABAT); KPSNGL (SEQ ID NO: 264) (Chothia) | TITTTEGYWFFDV (SEQ ID NO: 29) |
| GUCY2C-0210_VH | GYTFTSYWMH (SEQ ID NO: 27) (ABM); SYWMH (SEQ ID NO: 259) (Kabat) | EIKPSNGLTNYIEKFKN (SEQ ID NO: 28) (KABAT); KPSNGL (SEQ ID NO: 264) (Chothia) | TITTTEGYWFFDV (SEQ ID NO: 29) |
| GUCY2C-0212_VH | GYTFTSYWMH (SEQ ID NO: 27) (ABM); SYWMH (SEQ ID NO: 259) (Kabat) | EIKPSNGLTNYIEKFKN (SEQ ID NO: 28) (KABAT); KPSNGL (SEQ ID NO: 264) (Chothia) | TITTTEGYWFFDV (SEQ ID NO: 29) |
| GUCY2C-1186_VH | GYTFTSYWMH (SEQ ID NO: 27) (ABM); SYWMH (SEQ ID NO: 259) (Kabat) | EIKPSNGLTNIHPKFKN (SEQ ID NO: 66) (KABAT); KPSNGL (SEQ ID NO: 264) (Chothia) | TITTTEGYWFFDV (SEQ ID NO: 29) |
| GUCY2C-1476_VH | GYTFTSYWMH (SEQ ID NO: 27) (ABM); SYWMH (SEQ ID NO: 259) (Kabat) | EIKPSNGLTNYNEKFKN (SEQ ID NO: 68) (KABAT); KPSNGL (SEQ ID NO: 264) (Chothia) | TITTTEGYWFFDV (SEQ ID NO: 29) |
| GUCY2C-1478_VH | GYTFTSYWMH (SEQ ID NO: 27) (ABM); SYWMH (SEQ ID NO: 259) (Kabat) | EIKPSNGLTNVHEKFKN (SEQ ID NO: 70) (KABAT); KPSNGL (SEQ ID NO: 264) (Chothia) | TITTTEGYWFFDV (SEQ ID NO: 29) |
| GUCY2C-1512_VH | GYTFTSYWMH (SEQ ID NO: 27) (ABM); SYWMH (SEQ ID NO: 259) (Kabat) | EIKPSNGLTNYAEQFKN (SEQ ID NO: 72) (KABAT); KPSNGL (SEQ ID NO: 264) (Chothia) | TITTTEGYWFFDV (SEQ ID NO: 29) |
| GUCY2C-1554_VH; GUCY2C-1608_VH | GFTFSSYWMH (SEQ ID NO: 74) (ABM); SYWMH (SEQ ID NO: 259) (Kabat) | EIKPSNELTNVHEKFKD (SEQ ID NO: 75) (KABAT); KPSNEL (SEQ ID NO: 267) (Chothia) | TITTTEGYWFFDV (SEQ ID NO: 29) |

TABLE 2-continued

| | Light chain | | |
|---|---|---|---|
| mAb | VL CDR1 | VL CDR2 | VL CDR3 |
| GUCY2C-0074_VL | RASESVDNYGISFMN (SEQ ID NO: 93) | AASNPGS (SEQ ID NO: 94) | QQSKEVPYT (SEQ ID NO: 95) |
| GUCY2C-0077_VL | RASESVDNFDISFMN (SEQ ID NO: 101) | AASNQGS (SEQ ID NO: 102) | QQSKEVPYT (SEQ ID NO: 95) |
| GUCY2C-0078_VL | RAGESVDNFDISFMN (SEQ ID NO: 105) | AASNQGS (SEQ ID NO: 102) | QQSKEVPYT (SEQ ID NO: 95) |
| GUCY2C-0098_VL | RASESVDYYGTSLMN (SEQ ID NO: 107) | AASNVES (SEQ ID NO: 108) | QQTRKVYT (SEQ ID NO: 109) |
| GUCY2C-0104_VL | RASKGVTTSGYSYMH (SEQ ID NO: 113) | LASNLES (SEQ ID NO: 114) | QHSREFPLT (SEQ ID NO: 115) |
| GUCY2C-0105_VL | KSSQSLLYSSNQKNYLA (SEQ ID NO: 120) | WASTRES (SEQ ID NO: 78) | QQYYSYPT (SEQ ID NO: 121) |
| GUCY2C-0240_VL | RASESVDNYGISFMN (SEQ ID NO: 93) | AASNPGS (SEQ ID NO: 94) | QQSKEVPYT (SEQ ID NO: 95) |
| GUCY2C-0315_VL | RASESVDNYGISFMN (SEQ ID NO: 93) | AASNPGS (SEQ ID NO: 94) | QQSKEVPYT (SEQ ID NO: 95) |
| GUCY2C-0179_VL | KSSQSLLYSSNQKNYLA (SEQ ID NO: 120) | WASTRES (SEQ ID NO: 78) | QQYYSYPT (SEQ ID NO: 121) |
| GUCY2C-0193_VL | RASESVDYYGTSLMQ (SEQ ID NO: 107) | AASNVES (SEQ ID NO: 108) | QQTRKVYT (SEQ ID NO: 109) |
| GUCY2C-0210_VL | RASESVDYYGTSLMQ (SEQ ID NO: 107) | AASNVES (SEQ ID NO: 108) | QQTRKVYT (SEQ ID NO: 109) |
| GUCY2C-0247_VL | RASESVDYYGTSLMQ (SEQ ID NO: 107) | AASNVES (SEQ ID NO: 108) | QQTRKVYT (SEQ ID NO: 109) |
| GUCY2C-1186_VL | RASESVDYYGTSLMQ (SEQ ID NO: 107) | AASKRYS (SEQ ID NO: 141) | QQTRKAYT (SEQ ID NO: 142) |
| GUCY2C-1467_VL | RASESVDYYGTSLMQ (SEQ ID NO: 107) | AASKLWS (SEQ ID NO: 144) | QQTRKVYT (SEQ ID NO: 109) |
| GUCY2C-1476_VL | RASESVDYYGTSLMQ (SEQ ID NO: 107) | AASKVAP (SEQ ID NO: 146) | QQTRKAYT (SEQ ID NO: 142) |
| GUCY2C-1478_VL | RASESVDYYGSSLLQ (SEQ ID NO: 148) | AASKLAS (SEQ ID NO: 149) | QQTRKAYT (SEQ ID NO: 142) |
| GUCY2C-1481_VL | RASESVDYYGTSLMQ (SEQ ID NO: 107) | AASNIAP (SEQ ID NO: 151) | QQTRKAYT (SEQ ID NO: 142) |
| GUCY2C-1512_VL | RASESVDYYGSSLMQ (SEQ ID NO: 153) | AASKRYS (SEQ ID NO: 141) | QQTRKEYT (SEQ ID NO: 154) |
| GUCY2C-1518_VL | RASESVDYYGSSLMQ (SEQ ID NO: 153) | AASNVAP (SEQ ID NO: 157) | QQTRKAYT (SEQ ID NO: 142) |
| GUCY2C-1526_VL | RASESVDYYGSSLMQ (SEQ ID NO: 153) | AASHRAS (SEQ ID NO: 159) | QQTRKAYT (SEQ ID NO: 142) |
| GUCY2C-1527_VL | RASESVDYYGTSLMQ (SEQ ID NO: 107) | AASNVAS (SEQ ID NO: 161) | QQTRKEYT (SEQ ID NO: 154) |
| GUCY2C-1538_VL | RASESVDYYGHSLMQ (SEQ ID NO: 163) | AASNRYS (SEQ ID NO: 164) | QQTRKAYS (SEQ ID NO: 165) |
| GUCY2C-1554_VL | RASQSVDYYGSSLLQ (SEQ ID NO: 167) | DASKLAS (SEQ ID NO: 168) | QQERKAYT (SEQ ID NO: 169) |
| GUCY2C-1555_VL | RASQSVDYYGSSLLQ (SEQ ID NO: 167) | AASKLAS (SEQ ID NO: 149) | QQERKAYT (SEQ ID NO: 169) |

TABLE 2-continued

| | | | |
|---|---|---|---|
| GUCY2C-1556_VL | RASQSVDYYGSSLLQ (SEQ ID NO: 167) | DASKLAS (SEQ ID NO: 168) | QQTRKAYT (SEQ ID NO: 142) |
| GUCY2C-1557_VL | RASQSVDYYGSSLLQ (SEQ ID NO: 167) | AASKLAS (SEQ ID NO: 149) | QQTRKAYT (SEQ ID NO: 142) |
| GUCY2C-1590_VL | RASESVDYYGSSLLQ (SEQ ID NO: 148) | DASKLAS (SEQ ID NO: 168) | QQERKAYT (SEQ ID NO: 169) |
| GUCY2C-1591_VL | RASESVDYYGSSLLQ (SEQ ID NO: 148) | AASKLAS (SEQ ID NO: 149) | QQERKAYT (SEQ ID NO: 169) |
| GUCY2C-1592_VL | RASESVDYYGSSLLQ (SEQ ID NO: 148) | DASKLAS (SEQ ID NO: 168) | QQTRKAYT (SEQ ID NO: 142) |
| GUCY2C-1608_VL | RASESVDYYGSSLLQ (SEQ ID NO: 148) | AASKLAS (SEQ ID NO: 149) | QQTRKAYT (SEQ ID NO: 142) |

In one aspect, provided is an antibody having any one of partial light chain sequence and/or any one of partial heavy chain sequence as listed in Table 3. In one embodiment, provided is an isolated antibody, or an antigen-binding fragment thereof, which specifically binds to CD3, wherein the antibody comprises: a VH region comprising a VH CDR1, VH CDR2, and VH CDR3 of the VH sequence shown in SEQ ID NO: 1, 9, or 273; and/or a VL region comprising VL CDR1, VL CDR2, and VL CDR3 of the VL sequence shown in SEQ ID NO: 76, 84, 90, 274, 275, or 276.

TABLE 3

| Description | Sequence |
|---|---|
| CD3-0001_VH | EVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSS (SEQ ID NO: 1) |
| CD3-0006_VH | EVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSS (SEQ ID NO: 9) |
| 2B5-1038 VH, 2B5-1039 VH, 2B5-1040 VH | EVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSS (SEQ ID NO: 273) |
| CD3-0001_VL | DIQMTQSPSSLSASVGDRVTITCTSSQSLFNVRSRKNYLAWYQQKPGKAPKLLIYWASTRESGVPSRFSGSGSGTDFTLTISSLQPEDFATYYCKQSYDLFTFGGGTKVEIK (SEQ ID NO: 76) |
| CD3-0004_VL | DIVMTQSPDSLAVSLGERATINCKKSSQSLFNVRSRKNYLAWYQQKPGQPPKLLISWASTRESGVPDRFSGSGSGTDFTLTISSLQAEDVAVYYCKQSYDLFTFGSGTKLEIK (SEQ ID NO: 84) |
| CD3-0006_VL | DIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIK (SEQ ID NO: 90) |
| 2B5-1038 VL | DIQMTQSPSSLSASVGDRVTITCTSDQSLFNVRSGKNYLAWYQQKPGKAPKLLIYWASDRESGVPSRFSGSGSGTDFTLTISSLQPEDFATYYCKQSYDLFTFGGGTKVEIK (SEQ ID NO: 274) |
| 2B5-1039 VL | DIQMTQSPSSLSASVGDRVTITCTSSESLFNVRSGKNYLAWYQQKPGKAPKLLIYWASDRESGVPSRFSGSGSGTDFTLTISSLQPEDFATYYCKQSYDLFTFGGGTKVEIK (SEQ ID NO: 275) |
| 2B5-1040 VL | DIQMTQSPSSLSASVGDRVTITCTSSQSLFNVRSGKNYLAWYQQKPGKAPKLLIYWASDRESGVPSRFSGSGSGTDFTLTISSLQPEDFATYYCKQSYDLFTFGGGTKVEIK (SEQ ID NO: 276) |

In Table 3, the underlined sequences are CDR sequences according to Kabat and in bold according to Chothia. The AbM definition was used for VH CDR1.

Table 4 provides examples of CDR sequences for CD3 antibodies provided herein.

TABLE 4

| | Heavy Chain | | |
|---|---|---|---|
| mAb | VH CDR1 | VH CDR2 | VH CDR3 |
| CD3-0001_VH | GFTFSDYYMT (SEQ ID NO: 2) (ABM); DYYMT (SEQ ID NO: 268) (Kabat) | FIRNRARGYTSDHNPSVKG (SEQ ID NO: 3) (Kabat); RNRARGYT (SEQ ID NO: 269) (Chothia) | DRPSYYVLDY (SEQ ID NO: 4) |
| CD3-0006_VH | GFTFSDYYMT (SEQ ID NO: 2) (ABM); DYYMT (SEQ ID NO: 268) (Kabat) | FIRNQARGYTSDHNPSVKG (SEQ ID NO: 10) (Kabat); RNQARGYT (SEQ ID NO: 270) (Chothia) | DRPSYYVLDY (SEQ ID NO: 4) |

TABLE 4-continued

| mAb | | | |
|---|---|---|---|
| 2B5-1038 | DYYMT (SEQ ID NO: 268) (Kabat) GFTFSDY (SEQ ID NO: 277) (Chothia) GFTFSDYYMT (SEQ ID NO: 2) (extended) | FIRNQARGYTSDHNPSV KG (SEQ ID NO: 10) (Kabat) RNQARGYT (SEQ ID NO: 270) (Chothia) | DRPSYYVLDY (SEQ ID NO: 4) |
| 2B5-1039 | DYYMT (SEQ ID NO: 268) (Kabat) GFTFSDY (SEQ ID NO: 277) (Chothia) GFTFSDYYMT (SEQ ID NO: 2) (extended) | FIRNQARGYTSDHNPSV KG (SEQ ID NO: 10) (Kabat) RNQARGYT (SEQ ID NO: 270) (Chothia) | DRPSYYVLDY (SEQ ID NO: 4) |
| 2B5-1040 | DYYMT (SEQ ID NO: 268) (Kabat) GFTFSDY (SEQ ID NO: 277) (Chothia) GFTFSDYYMT (SEQ ID NO: 2) (extended) | FIRNQARGYTSDHNPSV KG (SEQ ID NO: 10) (Kabat) RNQARGYT (SEQ ID NO: 270) (Chothia) | DRPSYYVLDY (SEQ ID NO: 4) |

| | Light chain | | |
|---|---|---|---|
| mAb | VL CDR1 | VL CDR2 | VL CDR3 |
| CD3-0001_VL | TSSQSLFNVRSRKNYLA (SEQ ID NO: 77) | WASTRES (SEQ ID NO: 78) | KQSYDLFT (SEQ ID NO: 79) |
| CD3-0004_VL | KSSQSLFNVRSRKNYLA (SEQ ID NO: 85) | WASTRES (SEQ ID NO: 78) | KQSYDLFT (SEQ ID NO: 79) |
| CD3-0006_VL | TSSQSLFNVRSQKNYLA (SEQ ID NO: 91) | WASTRES (SEQ ID NO: 78) | KQSYDLFT (SEQ ID NO: 79) |
| 2B5-1038 | TSDQSLFNVRSGKNYLA (SEQ ID NO: 278) | WASDRES (SEQ ID NO: 281) | KQSYDLFT (SEQ ID NO: 79) |
| 2B5-1039 | TSSESLFNVRSGKNYLA (SEQ ID NO: 279) | WASDRES (SEQ ID NO: 281) | KQSYDLFT (SEQ ID NO: 79) |
| 2B5-1040 | TSSQSLFNVRSGKNYLA (SEQ ID NO: 280) | WASDRES (SEQ ID NO: 281) | KQSYDLFT (SEQ ID NO: 79) |

In one embodiment, the invention provides a bispecific antibody wherein: (a) the GUCY2c VL CDR1 comprises a sequence of SEQ ID NO: 93, 101, 105, 107, 113, 120, 148, 153, 163, or 167; the GUCY2c VL CDR2 comprises a sequence of SEQ ID NO: 78, 94, 102, 108, 114, 141, 144, 146, 149, 151, 157, 159, 161, 164, or 168; and the GUCY2c VL CDR3 comprises a sequence of SEQ ID NO: 95, 109, 115, 121, 142, 154, 165, or 169; (b) the CD3 VH CDR1 comprises a sequence of SEQ ID NO: 2, 268, or 277; the CD3 VH CDR2 comprises a sequence of SEQ ID NO: 3, 10, 269, or 270; and the CD3 VH CDR3 comprises a sequence of SEQ ID NO: 4; (c) the CD3 VL CDR1 comprises a sequence of SEQ ID NO: 77, 85, 91, 278, 279, or 280; the CD3 VL CDR2 comprises a sequence of SEQ ID NO: 78 or 281; and the CD3 VL CDR3 comprises a sequence of SEQ ID NO: 79; and (d) the GUCY2c VH CDR1 comprises a sequence of SEQ ID NO: 12, 20, 27, 34, 42, 74, 257, 258, 259, 260, or 261; the GUCY2c VH CDR2 comprises a sequence of SEQ ID NO: 13, 21, 28, 35, 43, 53, 66, 68, 70, 72, 75, 262, 263, 264, 265, 266, or 267; and the GUCY2c VH CDR3 comprises a sequence of SEQ ID NO: 14, 22, 29, 36, or 44.

In some such embodiments, the invention provides a bispecific antibody wherein: (a) the GUCY2c VH CDR1 comprises the sequence of SEQ ID NO: 74 or 259; (b) the GUCY2c VH CDR2 comprises the sequence of SEQ ID NO: 75 or 267; (c) the GUCY2c VH CDR3 comprises the sequence of SEQ ID NO: 29; (d) the GUCY2c VL CDR1 comprises the sequence of SEQ ID NO: 148; (e) the GUCY2c VL CDR2 comprises the sequence of SEQ ID NO: 149; and (f) the GUCY2c VL CDR3 comprises the sequence of SEQ ID NO: 142.

In further embodiments of each of the foregoing, the invention provides a bispecific antibody wherein: (a) the CD3 VH CDR1 comprises the sequence of SEQ ID NO: 2, 268, or 277; (b) the CD3 VH CDR2 comprises the sequence of SEQ ID NO: 10 or 270; (c) the CD3 VH CDR3 comprises the sequence of SEQ ID NO: 4; (d) the CD3 VL CDR1 comprises the sequence of SEQ ID NO: 91, 278, 279, or 280; (e) the CD3 VL CDR2 comprises the sequence of SEQ ID NO: 78 or 281; and (f) the CD3 VL CDR3 comprises the sequence of SEQ ID NO: 79.

In a particular embodiment, the invention provides a polynucleotide comprising a nucleotide sequence encoding the heavy chain and/or the light chain variable regions of an antibody as described herein and in Table 5, Table 37A and Table 37B, including: CD3-0001, CD3-0004, CD3-0006, GUCY2C-0074, GUCY2C-0077, GUCY2C-0078, GUCY2C-0098, GUCY2C-0104, GUCY2C-0105, GUCY2C-0240, GUCY2C-0315, GUCY2C-0179, GUCY2C-0193, GUCY2C-0210, GUCY2C-0212, GUCY2C-0241, GUCY2C-0247, GUCY2C-1186, GUCY2C-1467, GUCY2C-1478, GUCY2C-1481, GUCY2C-1512, GUCY2C-1518, GUCY2C-1526, GUCY2C-1527, GUCY2C-1538, GUCY2C-1554, GUCY2C-1555, GUCY2C-1556, GUCY2C-1557, GUCY2C-1590, GUCY2C-1591, GUCY2C-1592, GUCY2C-1608, huIGHV3-7, huIGKV1-39, GUCY2C-0405, GUCY2C-0486, GUCY2C-1640, GUCY2C-0250, GUCY2C-1678, GUCY2C-1679, or GUCY2C-1680.

Sequences detailed herein describe GUCY2c antibodies, CD3 antibodies and CD3-GUCY2c bispecific antibodies. In some embodiment, these antibodies are referred to by their clone ID (e.g., GUCY2C-0098). These clone IDs may be used to refer to the mature antibody (e.g., IgG or CD3 bispecific antibody). The clone ID may also refer to the unique VH or VL regions found in that antibody. For clone IDs representing CD3-GUCY2c bispecific antibodies (e.g., GUCY2C-0098), there may also be a unique anti-CD3 antibody region (e.g., VL and/or VH regions) incorporated in the mature protein. Table 5 shows the format of the antibody and the anti-CD3 region (if any) present in that mature protein. Tables 37A and 37B further show the component sequences of these mature GUCY2c antibodies, anti-CD3 IgGs and CD3-GUCY2c bispecific antibodies.

TABLE 5

| Sequence | Description | Format | Anti-CD3 Region |
| --- | --- | --- | --- |
| CD3-0001 | Anti-CD3 antibody | IgG | CD3-0001 |
| CD3-0004 | Anti-CD3 antibody | IgG | CD3-0004 |
| CD3-0006 | Anti-CD3 antibody | IgG | CD3-0006 |
| GUCY2C-0074 | CD3-GUCY2c bispecific antibody | CD3 bispecific | CD3-0004 |
| GUCY2C-0077 | CD3-GUCY2c bispecific antibody | CD3 bispecific | CD3-0004 |
| GUCY2C-0078 | CD3-GUCY2c bispecific antibody | CD3 bispecific | CD3-0004 |
| GUCY2C-0098 | CD3-GUCY2c bispecific antibody | CD3 bispecific | CD3-0004 |
| GUCY2C-0104 | CD3-GUCY2c bispecific antibody | CD3 bispecific | CD3-0004 |
| GUCY2C-0105 | CD3-GUCY2c bispecific antibody | CD3 bispecific | CD3-0004 |
| GUCY2C-0240 | CD3-GUCY2c bispecific antibody | CD3 bispecific | CD3-0004 |
| GUCY2C-0315 | CD3-GUCY2c bispecific antibody | CD3 bispecific | CD3-0004 |
| GUCY2C-0179 | CD3-GUCY2c bispecific antibody | CD3 bispecific | CD3-0004 |
| GUCY2C-0193 | GUCY2c antibody | IgG | None |
| GUCY2C-0210 | GUCY2c antibody | IgG | None |
| GUCY2C-0212 | GUCY2c antibody | IgG | None |
| GUCY2C-0241 | GUCY2c antibody | IgG | None |
| GUCY2C-0247 | CD3-GUCY2c bispecific antibody | CD3 bispecific | CD3-0004 |
| GUCY2C-1186 | CD3-GUCY2c bispecific antibody | CD3 bispecific | CD3-0006 |
| GUCY2C-1467 | CD3-GUCY2c bispecific antibody | CD3 bispecific | CD3-0006 |
| GUCY2C-1476 | CD3-GUCY2c bispecific antibody | CD3 bispecific | CD3-0006 |
| GUCY2C-1478 | CD3-GUCY2c bispecific antibody | CD3 bispecific | CD3-0006 |
| GUCY2C-1481 | CD3-GUCY2c bispecific antibody | CD3 bispecific | CD3-0006 |
| GUCY2C-1512 | CD3-GUCY2c bispecific antibody | CD3 bispecific | CD3-0006 |
| GUCY2C-1518 | CD3-GUCY2c bispecific antibody | CD3 bispecific | CD3-0006 |
| GUCY2C-1526 | CD3-GUCY2c bispecific antibody | CD3 bispecific | CD3-0006 |
| GUCY2C-1527 | CD3-GUCY2c bispecific antibody | CD3 bispecific | CD3-0006 |
| GUCY2C-1538 | CD3-GUCY2c bispecific antibody | CD3 bispecific | CD3-0006 |
| GUCY2C-1554 | CD3-GUCY2c bispecific antibody | CD3 bispecific | CD3-0006 |
| GUCY2C-1555 | CD3-GUCY2c bispecific antibody | CD3 bispecific | CD3-0006 |
| GUCY2C-1556 | CD3-GUCY2c bispecific antibody | CD3 bispecific | CD3-0006 |
| GUCY2C-1557 | CD3-GUCY2c bispecific antibody | CD3 bispecific | CD3-0006 |
| GUCY2C-1590 | CD3-GUCY2c bispecific antibody | CD3 bispecific | CD3-0006 |
| GUCY2C-1591 | CD3-GUCY2c bispecific antibody | CD3 bispecific | CD3-0006 |
| GUCY2C-1592 | CD3-GUCY2c bispecific antibody | CD3 bispecific | CD3-0006 |
| GUCY2C-1608 | CD3-GUCY2c bispecific antibody | CD3 bispecific | CD3-0006 |
| huIGHV3-7 | Human immunoglobulin VH germline | VH | NA |
| huIGKV1-39 | Human immunoglobulin VL germline | VL | NA |
| GUCY2C-0405 | Anti-GUCY2c scFv-Fc fusion protein | scFv-Fc fusion | NA |
| GUCY2C-0486 | GUCY2c antibody | IgG | NA |
| GUCY2C-1640 | GUCY2c antibody | IgG | NA |
| GUCY2C-0250 | CD3-GUCY2c bispecific antibody | CD3 bispecific | CD3-0001 |
| GUCY2C-1678 | CD3-GUCY2c bispecific antibody | CD3 bispecific | 2B5-1038 |
| GUCY2C-1679 | CD3-GUCY2c bispecific antibody | CD3 bispecific | 2B5-1039 |
| GUCY2C-1680 | CD3-GUCY2c bispecific antibody | CD3 bispecific | 2B5-1040 |

Certain of the CD3 antibodies provided herein may be referred to by more than one name. For example, CD3-0001 may be referred to as 2B5v1 or h2B5v1; CD3-0004 may be referred to as 2B4 or h2B4; and CD3-0006 may be referred to as 2B5v6 or h2B5v6.

Certain of the CD3 antibodies provided herein include, but are not limited to, variants of CD3-0006 (also referred to as 2B5v6 or h2B5v6). For example, variants of CD3-0006 include, but are not limited to, 265-1038, 265-1039 and 265-1040.

The binding affinity ($K_D$) of the antibodies as described herein to GUCY2c (such as human GUCY2c (e.g., (SEQ ID NO: 224, 230 or 232), or to CD3 (SEQ ID NO: 242), can be about 0.001 nM to about 6500 nM. In some embodiments, the binding affinity is about any of 6500 nM, 6000 nM, 5500 nM, 4500 nM, 4000 nM, 3500 nM, 3000 nM, 2500 nM, 2000 nM, 1500 nM, 1000 nM, 750 nM, 500 nM, 400 nM, 300 nM, 250 nM, 200 nM, 150 nM, 100 nM, 75 nM, 50 nM, 45 nM, 40 nM, 35 nM, 30 nM, 25 nM, 20 nM, 19 nM, 17 nM, 16 nM, 15 nM, 10 nM, 8 nM, 7.5 nM, 7 nM, 6.5 nM, 6 nM, 5.5 nM, 5 nM, 4 nM, 3 nM, 2 nM, 1 nM, 0.5 nM, 0.3 nM, 0.1 nM, 0.01 nM, 0.002 nM, or 0.001 nM. In some embodiments, the binding affinity is less than about any of 6500 nM, 6000 nM, 5500 nM, 5000 nM, 4000 nM, 3000 nM, 2000 nM, 1000 nM, 900 nM, 800 nM, 500 nM, 250 nM, 200 nM, 100 nM, 50 nM, 30 nM, 20 nM, 10 nM, 7.5 nM, 7 nM, 6.5 nM, 6 nM, 5 nM, 4.5 nM, 4 nM, 3.5 nM, 3 nM, 2.5 nM, 2 nM, 1.5 nM, 1 nM, 0.5 nM, 0.1 nM, 0.05 nM, 0.01 nM or lower nM. In a certain embodiment, the antibody has a $K_D$ of about 80 to about 200 pM, preferably about 100 to about 150 pM.

In some embodiments, the present invention provides an antibody that binds to GUCY2c and/or CD3 and competes with the antibody as described herein, including: CD3-0001, CD3-0004, CD3-0006, GUCY2C-0074, GUCY2C-0077, GUCY2C-0078, GUCY2C-0098, GUCY2C-0104, GUCY2C-0105, GUCY2C-0240, GUCY2C-0315, GUCY2C-0179, GUCY2C-0193, GUCY2C-0210, GUCY2C-0212, GUCY2C-0241, GUCY2C-0247, GUCY2C-1186, GUCY2C-1467, GUCY2C-1478, GUCY2C-1481, GUCY2C-1512, GUCY2C-1518, GUCY2C-1526, GUCY2C-1527, GUCY2C-1538, GUCY2C-1554, GUCY2C-1555, GUCY2C-1556, GUCY2C-1557, GUCY2C-1590, GUCY2C-1591, GUCY2C-1592, GUCY2C-1608, huIGHV3-7, huIGKV1-39, GUCY2C-0405, GUCY2C-0486, GUCY2C-1640, GUCY2C-0250, GUCY2C-1678, GUCY2C-1679, and GUCY2C-1680 (Table 5).

In one aspect, provided is an antibody having any one of framework region sequences as listed in Table 6. In some embodiments, the invention provides an antibody as described herein, further comprising a human or humanized VH framework and a human or humanized VL framework. In some such embodiments, the VH framework comprises a sequence of SEQ ID NO: 5, 6, 7, 8, 15, 16, 17, 18, 23, 24, 25, 30, 31, 32, 37, 38, 39, 40, 45, 46, 47, 49, 50, 51, 54, 55, 56, 58, 59, 61, or 63; and/or the VL framework comprises a sequence of SEQ ID NO: 80, 81, 82, 83, 86, 87, 88, 89, 96, 97, 98, 99, 103, 110, 111, 116, 117, 118, 122, 123, 124, 126, 127, 128, 130, 131, 132, 133, 135, 139, or 155.

TABLE 6

| Framework Region Description | Sequence |
| --- | --- |
| CD3-0001_VH FW_H1 | EVQLVESGGGLVQPGGSLRLSCAAS (SEQ ID No: 5) |
| CD3-0001_VH FW_H2 | WVRQAPGKGLEWVA (SEQ ID No: 6) |
| CD3-0001_VH FW_H3 | RFTISRDNAKNSLYLQMNSLRAEDTAVYYCAR (SEQ ID No: 7) |
| CD3-0001_VH FW_H4 | WGQGTTVTVSS (SEQ ID No: 8) |
| GUCY2C-0074_VH FW_H1 | EVQLQQSGAELARPGASVNLSCKAS (SEQ ID No: 15) |
| GUCY2C-0074_VH FW_H2 | WVKQRPGQGLEWIG (SEQ ID No: 16) |
| GUCY2C-0074_VH FW_H3 | KATLTADKSSTAYMQLSSLASEDSAVYYCVR (SEQ ID No: 17) |
| GUCY2C-0074_VH FW_H4 | WGQGTSVTVSS (SEQ ID No: 18) |
| GUCY2C-0077_VH FW_H1 | EVQLQQSGAELARPGASVKLSCKAS (SEQ ID No: 23) |
| GUCY2C-0077_VH FW_H2 | WIKQRPGQGLEWIG (SEQ ID No: 24) |
| GUCY2C-0077_VH FW_H3 | KATLTADKSSNTAYMQLSSLASEDSAVYYCAR (SEQ ID No: 25) |
| GUCY2C-0098_VH FW_H1 | QVQLQQPGAELVKPGASVKLSCKAS (SEQ ID No: 30) |
| GUCY2C-0098_VH FW_H3 | KATLTVDKSATTAYMQLSSLTAEDSAVYYCTR (SEQ ID No: 31) |

TABLE 6-continued

| Framework Region Description | Sequence |
|---|---|
| GUCY2C-0098_VH FW_H4 | WGAGTTVTVSS (SEQ ID No: 32) |
| GUCY2C-0104_VH FW_H1 | EVQLQQSGAELVKPGASVKLSCTAS (SEQ ID NO: 37) |
| GUCY2C-0104_VH FW_H2 | WVKQRPEQGLEWIG (SEQ ID NO: 38) |
| GUCY2C-0104_VH FW_H3 | KATITADTSSNTAYLQLSSLTSEDTAVFYCSS (SEQ ID NO: 39) |
| GUCY2C-0104_VH FW_H4 | WGQGTTLTVSS (SEQ ID NO: 40) |
| GUCY2C-0105_VH FW_H1 | EVQLQQSGPELVKPGASVKISCKAS (SEQ ID NO: 45) |
| GUCY2C-0105_VH FW_H2 | WVKQSHGKSLEWIG (SEQ ID NO: 46) |
| GUCY2C-0105_VH FW_H3 | KATLTVDKSSSTAYMHLNSLTSEDSAVYYCAR (SEQ ID NO: 47) |
| GUCY2C-0240_VH FW_H2 | WVRQAPGKGLEWIG (SEQ ID NO: 49) |
| GUCY2C-0240_VH FW_H3 | RFTISADKAKNSAYLQMNSLRAEDTAVYYCVR (SEQ ID NO: 50) |
| GUCY2C-0240_VH FW_H4 | WGQGTLVTVSS (SEQ ID NO: 51) |
| GUCY2C-0315_VH FW_H1 | QVQLVQSGAEVKKPGASVKVSCKAS (SEQ ID NO: 54) |
| GUCY2C-0315_VH FW_H2 | WVRQAPGQGLEWIG (SEQ ID NO: 55) |
| GUCY2C-0315_VH FW_H3 | RVTMTRDTSTSTVYMELSSLRSEDTAVYYCVR (SEQ ID NO: 56) |
| GUCY2C-0179_VH FW_H3 | RFTISVDKAKNSAYLQMNSLRAEDTAVYYCAR (SEQ ID NO: 58) |
| GUCY2C-0179_VH FW_H4 | WGQGTMVTVSS (SEQ ID NO: 59) |
| GUCY2C-0193_VH FW_H3 | RFTISVDKAKNSAYLQMNSLRAEDTAVYYCTR (SEQ ID NO: 61) |
| GUCY2C-0210_VH FW_H2 | WVRQAPGKGLEWIA (SEQ ID NO: 63) |
| CD3-0001_VL FW_L1 | DIQMTQSPSSLSASVGDRVTITC (SEQ ID NO: 80) |
| CD3-0001_VL FW_L2 | WYQQKPGKAPKLLIY (SEQ ID NO: 81) |
| CD3-0001_VL FW_L3 | GVPSRFSGSGSGTDFTLTISSLQPEDFATYYC (SEQ ID NO: 82) |
| CD3-0001_VL FW_L4 | FGGGTKVEIK (SEQ ID NO: 83) |
| CD3-0004_VL FW_L1 | DIVMTQSPDSLAVSLGERATINC (SEQ ID NO: 86) |
| CD3-0004_VL FW_L2 | WYQQKPGQPPKLLIS (SEQ ID NO: 87) |
| CD3-0004_VL FW_L3 | GVPDRFSGSGSGTDFTLTISSLQAEDVAVYYC (SEQ ID NO: 88) |
| CD3-0004_VL FW_L4 | FGSGTKLEIK (SEQ ID NO: 89) |

TABLE 6-continued

| Framework Region Description | Sequence |
|---|---|
| GUCY2C-0074_VL FW_L1 | DIVLTQSPASLAVSLGQRATISC (SEQ ID NO: 96) |
| GUCY2C-0074_VL FW_L2 | WFQQKPGQPPKLLIY (SEQ ID NO: 97) |
| GUCY2C-0074_VL FW_L3 | GVPARFSGSGSGTDFSLNIHPLEEDDTAMFFC (SEQ ID NO: 98) |
| GUCY2C-0074_VL FW_L4 | FGGGTKLEIK (SEQ ID NO: 99) |
| GUCY2C-0077_VL FW_L3 | GVPARFSGSGSGTDFSLNIHPMEEDDTAMYFC (SEQ ID NO: 103) |
| GUCY2C-0098_VL FW_L2 | WYQQKPGQPPKLLIY (SEQ ID NO: 110) |
| GUCY2C-0098_VL FW_L3 | GVPARFSGSGSGTDFSLNIHPVEEDDIAMYFC (SEQ ID NO: 111) |
| GUCY2C-0104_VL FW_L1 | DIVMTQSPASLAVSLGQRATISC (SEQ ID NO: 116) |
| GUCY2C-0104_VL FW_L3 | GVPARFSGSGSGTDFTLNIHPVEEEDAATYYC (SEQ ID NO: 117) |
| GUCY2C-0104_VL FW_L4 | FGAGTKLELK (SEQ ID NO: 118) |
| GUCY2C-0105_VL FW_L1 | DIVMTQSPSSLAVSVGEKVTVSC (SEQ ID NO: 122) |
| GUCY2C-0105_VL FW_L2 | WYQQRPGQSPKLLIY (SEQ ID NO: 123) |
| GUCY2C-0105_VL FW_L3 | GVPDRFTGSGSGTDFTLSISSVKAEDLAVYYC (SEQ ID NO: 124) |
| GUCY2C-0240_VL FW_L1 | DIQLTQSPSSLSASVGDRVTITC (SEQ ID NO: 126) |
| GUCY2C-0240_VL FW_L2 | WFQQKPGKAPKLLIY (SEQ ID NO: 127) |
| GUCY2C-0240_VL FW_L4 | FGQGTKLEIK (SEQ ID NO: 128) |
| GUCY2C-0315_VL FW_L1 | EIVLTQSPATLSLSPGERATLSC (SEQ ID NO: 130) |
| GUCY2C-0315_VL FW_L2 | WYQQKPGQAPRLLIY (SEQ ID NO: 131) |
| GUCY2C-0315_VL FW_L3 | GIPARFSGSGSGTDFTLTISSLEPEDFAVYYC (SEQ ID NO: 132) |
| GUCY2C-0315_VL FW_L4 | FGQGTKVEIK (SEQ ID NO: 133) |
| GUCY2C-0179_VL FW_L2 | WYQQKPGKSPKLLIY (SEQ ID NO: 135) |
| GUCY2C-0247_VL FW_L2 | WYQQKPGKPPKLLIY (SEQ ID NO: 139) |
| GUCY2C-1512_VL FW_L4 | FGQGTKLKIK (SEQ ID NO: 155) |

In one embodiment, the invention provides an antibody, wherein the VH region comprises the sequence of SEQ ID NO: 73, or a variant thereof with one or several conservative amino acid substitutions in residues that are not within the CDR region; and/or wherein the VL region comprises the sequence of SEQ ID NO: 147, or a variant thereof with one or several conservative amino acid substitutions in amino acids that are not within the CDR region.

In one aspect, the invention provides a bispecific antibody that specifically binds to GUCY2c and CD3, wherein the bispecific antibody comprises a first polypeptide chain and a second polypeptide chain. In one embodiment, the first polypeptide chain comprises an amino acid sequence as set forth in one or more of the SEQ ID NOs: 216 and 220. In another embodiment, the second polypeptide chain comprises an amino acid sequence as set forth in one or more of the SEQ ID NOs: 216 and 220. In a preferred embodiment, the first polypeptide chain comprises an amino acid sequence of SEQ ID NO: 216; and the second polypeptide chain comprises an amino acid sequence of SEQ ID NO: 220. In some such embodiments, the bispecific antibody capable of specific binding to an epitope of GUCY2c and to an epitope of CD3 comprising a first polypeptide chain and a second polypeptide chain, wherein the first polypeptide chain comprises a sequence of SEQ ID NO: 216 and the second polypeptide chain comprises a sequence of SEQ ID NO: 220. In one embodiment, the second polypeptide chain is any polypeptide which is to be associated with the first polypeptide chain via an interface.

In one such embodiment, the invention provides a bispecific antibody, wherein: (a) the first polypeptide chain comprises, in the N-terminal to C-terminal direction: (i) a Domain 1, comprising a VL of an a GUCY2c antibody (GUCY2c VL), and a VH of a CD3 antibody (CD3 VH), and (ii) a first heterodimer-promoting domain; and (b) the second polypeptide chain comprises, in the N-terminal to C-terminal direction: (i) a Domain 2, comprising a VL of an anti-CD3 antibody (CD3 VL), and a VH of a GUCY2c antibody (GUCY2c VH), and (ii) a second heterodimer-promoting domain; wherein the GUCY2c VL and the GUCY2c VH form a domain that specifically binds to GUCY2c; and the CD3 VL and the CD3 VH form a domain that specifically binds to CD3.

In another such embodiment, (a) the first polypeptide chain comprises, in the N-terminal to C-terminal direction: (i) a Domain 1, comprising a CD3 VL, and a GUCY2c VH, and (ii) a first heterodimer-promoting domain; and (b) the second polypeptide chain comprises, in the N-terminal to C-terminal direction: (i) a Domain 2 comprising a GUCY2c VL, and a CD3 VH, and (ii) a second heterodimer-promoting domain; wherein the GUCY2c VL and the GUCY2c VH form a domain that specifically binds to GUCY2c; and the CD3 VL and the CD3 VH form a domain that specifically binds to CD3.

In yet another such embodiment, (a) the first polypeptide chain comprises, in the N-terminal to C-terminal direction: (i) a Domain 1, comprising a GUCY2c VH, and a CD3 VL, and (ii) a first heterodimer-promoting domain; and (b) the second polypeptide chain comprises, in the N-terminal to C-terminal direction: (i) a Domain 2, comprising a CD3 VH, and a GUCY2c VL, and (ii) a second heterodimer-promoting domain; wherein the GUCY2c VH and the GUCY2c VL form a domain that specifically binds to GUCY2c; and the CD3 VH and the CD3 VL form a domain that specifically binds to CD3.

In a further embodiment, (a) the first polypeptide chain comprises, in the N-terminal to C-terminal direction: (i) a Domain 1, comprising a CD3 VH, and a GUCY2c VL, and (ii) a first heterodimer-promoting domain; and (b) the second polypeptide chain comprises, in the N-terminal to C-terminal direction: (i) a Domain 2, comprising a GUCY2c VH, and a CD3 VL, and (ii) a second heterodimer-promoting domain, wherein the GUCY2c VL and the GUCY2c VH form a domain that specifically binds to GUCY2c; and the CD3 VL and the CD3 VH form a domain that specifically binds to CD3.

The invention also provides isolated polynucleotides encoding the antibodies of the invention, and vectors and host cells comprising the polynucleotides. In one aspect, a polynucleotide comprises a nucleotide sequence encoding the heavy chain variable regions, the light chain variable regions, the CDR regions, the framework regions, the knob and hole Fc chains, the first polypeptide chains and the second polypeptide chains, as listed in Tables 1-7 and 38. In certain embodiments, a polynucleotide comprises a sequence encoding any of the antibodies CD3-0001, CD3-0004, CD3-0006, GUCY2C-0074, GUCY2C-0077, GUCY2C-0078, GUCY2C-0098, GUCY2C-0104, GUCY2C-0105, GUCY2C-0240, GUCY2C-0315, GUCY2C-0179, GUCY2C-0193, GUCY2C-0210, GUCY2C-0212, GUCY2C-0241, GUCY2C-0247, GUCY2C-1186, GUCY2C-1467, GUCY2C-1478, GUCY2C-1481, GUCY2C-1512, GUCY2C-1518, GUCY2C-1526, GUCY2C-1527, GUCY2C-1538, GUCY2C-1554, GUCY2C-1555, GUCY2C-1556, GUCY2C-1557, GUCY2C-1590, GUCY2C-1591, GUCY2C-1592, GUCY2C-1608, huIGHV3-7, huIGKV1-39, GUCY2C-0405, GUCY2C-0486, GUCY2C-1640, GUCY2C-0250, GUCY2C-1678, GUCY2C-1679, or GUCY2C-1680.

The sequence encoding the antibody of interest may be maintained in a vector in a host cell and the host cell can then be expanded and frozen for future use. Vectors (including expression vectors) and host cells are further described herein.

The invention also encompasses fusion proteins comprising one or more fragments or regions from the antibodies of this invention. In one embodiment, a fusion polypeptide is provided that comprises at least 10 contiguous amino acids of the variable light chain region shown in SEQ ID NO: 76, 84, 90, 92, 100, 104, 106, 112, 119, 125, 129, 134, 136, 137, 138, 140, 143, 145, 147, 150, 152, 156, 158, 160, 162, 166, 170, 171, 172, 173, 174, 175, 274, 275, or 276; and/or at least 10 contiguous amino acids of the variable heavy chain region shown in SEQ ID NO: 1, 9, 11, 19, 26, 33, 41, 48, 52, 57, 60, 62, 64, 65, 67, 69, 71, 73, or 273. In other embodiments, a fusion polypeptide is provided that comprises at least about 10, at least about 15, at least about 20, at least about 25, or at least about 30 contiguous amino acids of the variable light chain region and/or at least about 10, at least about 15, at least about 20, at least about 25, or at least about 30 contiguous amino acids of the variable heavy chain region. In another embodiment, the fusion polypeptide comprises a light chain variable region and/or a heavy chain variable region, as shown in any of the sequence pairs selected from among SEQ ID NOs: 73 and 147; 69 and 147; 60 and 138; 48 and 125; or 26 and 106. In another embodiment, the fusion polypeptide comprises one or more CDR(s). In still other embodiments, the fusion polypeptide comprises CDR H3 (VH CDR3) and/or CDR L3 (VL CDR3). For purposes of this invention, a fusion protein contains one or more antibodies and another amino acid sequence to which it is not attached in the native molecule, for example, a heterologous sequence or a homologous sequence from another region. Exemplary heterologous sequences include, but are not limited to, a tag such as a FLAG tag or a 6His tag. Tags are well known in the art. A fusion polypeptide can be created by methods known in the art, for example, synthetically or recombinantly. Typically, the fusion proteins of this invention are made by preparing an expressing a polynucleotide encoding them using recombinant methods described herein, although they may also be prepared by other means known in the art, including, for example, chemical synthesis.

The invention also encompasses scFv of antibodies of this invention. Single chain variable region fragments are made by linking light and/or heavy chain variable regions by using a short linking peptide (Bird et al., Science 242:423-426, 1988). An example of a linking peptide is GGGGSGGGGSGGGGSG (SEQ ID NO: 193), which bridges approximately 3.5 nm between the carboxy terminus of one variable region and the amino terminus of the other variable region. Linkers of other sequences have been designed and used (Bird et al., Science 242:423-426, 1988). Linkers should be short, flexible polypeptides and preferably comprised of less than about 20 amino acid residues. Linkers can in turn be modified for additional functions, such as attachment of drugs or attachment to solid supports. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as E. coli. Polynucleotides encoding the scFv of interest can be made by routine manipulations such as ligation of polynucleotides. The resultant scFv can be isolated using standard protein purification techniques known in the art.

Other forms of single chain antibodies, such as diabodies or minibodies are also encompassed. Diabodies are bivalent, bispecific antibodies in which heavy chain variable (VH) and light chain variable (VL) regions are expressed on a single polypeptide chain, but using a linker that is too short to allow for pairing between the two domains on the same chain, thereby forcing the domains to pair with complementary domains of another chain and creating two antigen binding sites (see e.g., Holliger, P., et al., Proc. Natl. Acad Sci. USA 90: 6444-6448, 1993; Poljak, R. J., et al., Structure 2:1121-1123, 1994). Minibody includes the VL and VH regions of a native antibody fused to the hinge region and CH3 domain of the immunoglobulin molecule. See, e.g., U.S. Pat. No. 5,837,821.

In one aspect, the invention provides compositions (such as a pharmaceutical compositions) comprising any of the polynucleotides of the invention. In some embodiments, the composition comprises an expression vector comprising a polynucleotide encoding any of the antibodies described herein. In still other embodiments, the composition comprises either or both of the polynucleotides shown in SEQ ID NO: 246 (encoding GUCY2C-1608 first polypeptide chain) and SEQ ID NO: 247 (encoding GUCY2C-1608 second polypeptide chain). Expression vectors and administration of polynucleotide compositions are further described herein.

Polynucleotides complementary to any such sequences are also encompassed by the present invention. Polynucleotides may be single-stranded (coding or antisense) or double-stranded, and may be DNA (genomic, cDNA or synthetic) or RNA molecules. RNA molecules include mature and immature mRNAs, such as precursor mRNAs (ore-s mRNA) or heterogeneous nuclear mRNAs (hnRNA) and mature mRNAs. Additional coding or non-coding sequences may, but need not, be present within a polynucleotide of the present invention, and a polynucleotide may, but need not, be linked to other molecules and/or support materials.

Polynucleotides may comprise a native sequence (i.e., an endogenous sequence that encodes an antibody or a portion thereof) or may comprise a variant of such a sequence. Polynucleotide variants contain one or more substitutions, additions, deletions and/or insertions such that the immunoreactivity of the encoded polypeptide is not diminished, relative to a native immunoreactive molecule. The effect on the immunoreactivity of the encoded polypeptide may generally be assessed as described herein. Variants preferably exhibit at least about 70% identity, more preferably, at least about 80% identity, yet more preferably, at least about 90% identity, and most preferably, at least about 95% identity to a polynucleotide sequence that encodes a native antibody or a portion thereof.

Two polynucleotide or polypeptide sequences are said to be "identical" if the sequence of nucleotides or amino acids in the two sequences is the same when aligned for maximum correspondence as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, or 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. Preferably, the "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e., the window size) and multiplying the results by 100 to yield the percentage of sequence identity.

Variants may also, or alternatively, be substantially homologous to a native gene, or a portion or complement thereof. Such polynucleotide variants are capable of hybridizing under moderately stringent conditions to a naturally occurring DNA sequence encoding a native antibody (or a complementary sequence).

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the present invention. Further, alleles of the genes comprising the polynucleotide sequences provided herein are within the scope of the present invention. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

In one aspect, the invention provides a method of making any of the polynucleotides described herein. For example, the polynucleotides of this invention can be obtained using chemical synthesis, recombinant methods, or PCR. Methods of chemical polynucleotide synthesis are well known in the art and need not be described in detail herein. One of skill in the art can use the sequences provided herein and a commercial DNA synthesizer to produce a desired DNA sequence.

For preparing polynucleotides using recombinant methods, a polynucleotide comprising a desired sequence can be inserted into a suitable vector, and the vector in turn can be introduced into a suitable host cell for replication and amplification, as further discussed herein. Polynucleotides may be inserted into host cells by any means known in the art. Cells are transformed by introducing an exogenous polynucleotide by direct uptake, endocytosis, transfection, F-mating or electroporation. Once introduced, the exogenous polynucleotide can be maintained within the cell as a non-integrated vector (such as a plasmid) or integrated into the host cell genome. The polynucleotide so amplified can be isolated from the host cell by methods well known within the art (e.g., Sambrook et al., 1989).

Alternatively, PCR allows reproduction of DNA sequences. PCR technology is well known in the art and is described in U.S. Pat. Nos. 4,683,195, 4,800,159, 4,754,065 and 4,683,202, as well as PCR: The Polymerase Chain Reaction, Mullis et al. eds., Birkauswer Press, Boston, 1994.

RNA can be obtained by using the isolated DNA in an appropriate vector and inserting it into a suitable host cell. When the cell replicates and the DNA is transcribed into RNA, the RNA can then be isolated using methods well known to those of skill in the art, as set forth in Sambrook et al., 1989, supra, for example.

Suitable cloning vectors may be constructed according to standard techniques, or may be selected from a large number of cloning vectors available in the art. While the cloning vector selected may vary according to the host cell intended to be used, useful cloning vectors will generally have the ability to self-replicate, may possess a single target for a particular restriction endonuclease, and/or may carry genes for a marker that can be used in selecting clones containing the vector. Suitable examples include plasmids and bacterial viruses, e.g., pUC18, pUC19, Bluescript (e.g., pBS SK+) and its derivatives, mp18, mp19, pBR322, pMB9, ColE1, pCR1, RP4, phage DNAs, and shuttle vectors such as pSA3 and pAT28. These and many other cloning vectors are available from commercial vendors such as BioRad, Stratagene, and Invitrogen.

Expression vectors generally are replicable polynucleotide constructs that contain a polynucleotide according to the invention. It is implied that an expression vector must be replicable in the host cells either as episomes or as an integral part of the chromosomal DNA. Suitable expression vectors include but are not limited to plasmids, viral vectors, including adenoviruses, adeno-associated viruses, retroviruses, cosmids, and expression vector(s) disclosed in PCT Publication No. WO87/04462. Vector components may generally include, but are not limited to, one or more of the following: a signal sequence; an origin of replication; one or more marker genes; suitable transcriptional controlling elements (such as promoters, enhancers and terminator). For expression (i.e., translation), one or more translational controlling elements are also usually required, such as ribosome binding sites, translation initiation sites, and stop codons.

The vectors containing the polynucleotides of interest can be introduced into the host cell by any of a number of appropriate means, including electroporation, transfection employing calcium chloride, rubidium chloride, calcium phosphate, DEAE-dextran, or other substances; microprojectile bombardment; lipofection; and infection (e.g., where the vector is an infectious agent such as vaccinia virus). The choice of introducing vectors or polynucleotides will often depend on features of the host cell.

Any host cells capable of over-expressing heterologous DNAs can be used for the purpose of isolating the genes encoding the antibody, polypeptide or protein of interest. Non-limiting examples of mammalian host cells include but not limited to COS, HeLa, and CHO cells. See also PCT Publication No. WO87/04462. Suitable non-mammalian host cells include prokaryotes (such as *E. coli* or *B. subtillis*) and yeast (such as *S. cerevisae*, *S. pombe*; or *K. lactis*). Preferably, the host cells express the cDNAs at a level of about 5 fold higher, more preferably, 10 fold higher, even more preferably, 20 fold higher than that of the corresponding endogenous antibody, or protein GUCY2c, or a GUCY2c domain (e.g., domains 1-4) is effected by an immunoassay or FACS. A cell overexpressing the antibody or protein of interest can be identified.

In one aspect, a GUCY2c antibody molecule will have an affinity for GUCY2c, e.g., as measured by direct binding or competition binding assays in the picomolar to micromolar affinity range, preferably in the picomolar to low nanomolar range.

Bispecific antibodies can be prepared using the antibodies disclosed herein. Methods for making bispecific antibodies are known in the art (see, e.g., Suresh et al., Methods in Enzymology 121:210, 1986). Traditionally, the recombinant production of bispecific antibodies was based on the coexpression of two immunoglobulin heavy chain-light chain pairs, with the two heavy chains having different specificities (Millstein and Cuello, Nature 305, 537-539, 1983).

In another embodiment, the bispecific antibody as described herein, comprises a full-length human antibody, wherein an antibody variable region of the heterodimeric protein is capable of recruiting the activity of a human immune effector cell by specifically binding to an effector antigen (e.g., CD3 antigen) located on the human immune effector cell, and wherein a second antibody variable region of the heterodimeric protein is capable of specifically binding to a target antigen. In some embodiments, the human antibody has an IgG1, IgG2, IgG3, or IgG4 isotype. In some embodiments, the heterodimeric protein comprises an immunologically inert Fc chain.

The human immune effector cell can be any of a variety of immune effector cells known in the art. For example, the immune effector cell can be a member of the human lymphoid cell lineage, including, but not limited to, a T cell (e.g., a cytotoxic T cell), a B cell, and a natural killer (NK) cell. The immune effector cell can also be, for example without limitation, a member of the human myeloid lineage, including, but not limited to, a monocyte, a neutrophilic granulocyte, and a dendritic cell. Such immune effector cells may have either a cytotoxic or an apoptotic effect on a target cell or other desired effect upon activation by binding of an effector antigen.

The effector antigen is an antigen (e.g., a protein or a polypeptide) that is expressed on the human immune effector cell. Examples of effector antigens that can be bound by the heterodimeric protein (e.g., a heterodimeric antibody or a bispecific antibody) include, but are not limited to, human CD3 (or CD3 (Cluster of Differentiation) complex), CD16, NKG2D, NKp46, CD2, CD28, CD25, CD64, and CD89.

The target cell can be a cell that is native or foreign to humans. In a native target cell, the cell may have been transformed to be a malignant cell or pathologically modified (e.g., a native target cell infected with a virus, a plasmodium, or a bacterium). In a foreign target cell, the cell is an invading pathogen, such as a bacterium, a plasmodium, or a virus.

The target antigen is expressed on a target cell in a diseased condition (e.g., an inflammatory disease, a proliferative disease (e.g., cancer), an immunological disorder, a neurological disease, a neurodegenerative disease, an autoimmune disease, an infectious disease (e.g., a viral infection or a parasitic infection), an allergic reaction, a graft-versus-host disease or a host-versus-graft disease). A target antigen is not effector antigen. Examples of the target antigens include, but are not limited to, GUCY2c, BCMA, EpCAM (Epithelial Cell Adhesion Molecule), CCR5 (Chemokine Receptor type 5), CD19, HER (Human Epidermal Growth Factor Receptor)-2/neu, HER-3, HER-4, EGFR (Epidermal Growth Factor Receptor), PSMA, CEA, MUC-1 (Mucin), MUC2, MUC3, MUC4, MUC5AC, MUC5B, MUC7, CIhCG, Lewis-Y, CD20, CD33, CD30, ganglioside GD3, 9-O-Acetyl-GD3, GM2, Globo H, fucosyl GM1, Poly SA, GD2, Carboanhydrase IX (MN/CA IX), CD44v6, Shh (Sonic Hedgehog), Wue-1, Plasma Cell Antigen, (membrane-bound) IgE, MCSP (Melanoma Chondroitin Sulfate Proteoglycan), CCR8, TNF-alpha precursor, STEAP, mesothelin, A33 Antigen, PSCA (Prostate Stem Cell Antigen), Ly-6; desmoglein 4, E-cadherin neoepitope, Fetal Acetylcholine Receptor, CD25, CA19-9 marker, CA-125 marker and MIS (Muellerian Inhibitory Substance) Receptor type II, sTn (sialylated Tn antigen; TAG-72), FAP (fibroblast activation antigen), endosialin, EGFRvIII, LG, SAS and CD63.

In one embodiment, the invention provides a bispecific antibody, wherein: (a) a GUCY2c VL CDR1, a GUCY2c VL CDR2, and a GUCY2c VL CDR3 of a GUCY2c VL comprising the sequence shown in SEQ ID NO: 92, 100, 104, 106, 112, 119, 125, 129, 134, 136, 137, 138, 140, 143, 145, 147, 150, 152, 156, 158, 160, 162, 166, 170, 171, 172, 173, 174, or 175; (b) a CD3 VH CDR1, a CD3 VH CDR2, and a CD3 VH CDR3 of a CD3 VH comprising the sequence shown in SEQ ID NOS: 1, 9, or 273; (c) a CD3 VL CDR1, a CD3 VL CDR2, and a CD3 VL CDR3 of a CD3 VL comprising the sequence shown in SEQ ID NO: 76, 84, 90, or 274, 275, or 276; and/or (d) a GUCY2c VH CDR1, a GUCY2c VH CDR2, and a GUCY2c VH CDR3 of a GUCY2c VH comprising the sequence shown in SEQ ID NO: 11, 19, 26, 33, 41, 48, 52, 57, 60, 62, 64, 65, 67, 69, 71, or 73.

In a particular embodiment, the present invention provides a bispecific antibody wherein: (a) the GUCY2c VH region comprises a sequence of SEQ ID NO: 73; and (b) the GUCY2c VL region comprises a sequence of SEQ ID NO: 147.

In some embodiments, the invention provides a bispecific antibody wherein: (a) the GUCY2c VL CDR1 comprises a sequence of SEQ ID NO: 93, 101, 105, 107, 113, 120, 148, 153, 163, or 167; the GUCY2c VL CDR2 comprises a sequence of SEQ ID NO: 78, 94, 102, 108, 114, 141, 144, 146, 149, 151, 157, 159, 161, 164, or 168; and the GUCY2c VL CDR3 comprises a sequence of SEQ ID NO: 95, 109, 115, 121, 142, 154, 165, or 169; (b) the CD3 VH CDR1 comprises a sequence of SEQ ID NO: 2, 268, or 277; the CD3 VH CDR2 comprises a sequence of SEQ ID NO: 3, 10, 269, or 270; and the CD3 VH CDR3 comprises a sequence of SEQ ID NO: 4; (c) the CD3 VL CDR1 comprises a sequence of SEQ ID NO: 77, 85, 91, 278, 279, or 280; the CD3 VL CDR2 comprises a sequence of SEQ ID NO: 78 or 281; and the CD3 VL CDR3 comprises a sequence of SEQ ID NO: 79; and (d) the GUCY2c VH CDR1 comprises a sequence of SEQ ID NO: 12, 20, 27, 34, 42, 74, 257, 258, 259, 260, or 261; the GUCY2c VH CDR2 comprises a sequence of SEQ ID NO: 13, 21, 28, 35, 43, 53, 66, 68, 70, 72, 75, 262, 263, 264, 265, 266, or 267; and the GUCY2c VH CDR3 comprises a sequence of SEQ ID NO: 14, 22, 29, 36, or 44.

In some embodiments, the antibodies useful in the present invention are monoclonal antibodies, polyclonal antibodies, antibody fragments (e.g., Fab, Fab', F(ab')2, Fv, Fc, etc.), chimeric antibodies, bispecific antibodies, heteroconjugate antibodies, single chain (ScFv), mutants thereof, fusion proteins comprising an antibody portion (e.g., a domain antibody), humanized antibodies, and any other modified configuration of the immunoglobulin molecule that comprises an antigen recognition site of the required specificity, including glycosylation variants of antibodies, amino acid sequence variants of antibodies, and covalently modified antibodies. The antibodies may be murine, rat, human, or any other origin (including chimeric or humanized antibodies).

In some embodiments, the GUCY2c or CD3 antibody as described herein is a monoclonal antibody. For example, the GUCY2c or CD3 antibody is a humanized monoclonal antibody or a chimeric monoclonal antibody.

The present invention encompasses a bispecific antibody comprising an Fc chain or domain, or portions thereof. In some embodiments, the Fc chain, or portion(s) thereof, comprises one or more constant domain(s) of the Fc chain of IgG1, IgG2, IgG3 or IgG4 (e.g., a CH2 or CH3 domain). In another embodiment, the invention encompasses molecules comprising an Fc chain or portion thereof, wherein the Fc chain or portion thereof comprises at least one amino acid modification (e.g. substitution) relative to a comparable wild-type Fc chain or portion thereof. Variant Fc regions are well known in the art, and are primarily used to alter the phenotype of the antibody comprising the variant Fc region as assayed in any of the binding activity or effector function assays well known in the art, e.g., ELISA, SPR analysis, or ADCC. Such variant Fc chains, or portions thereof, may extend the plasma half-life and stability exhibited by a bispecific antibody of the invention comprising an Fc chain or portion thereof. In another embodiment, the invention encompasses the use of any Fc variant known in the art.

In one embodiment, one or more modifications are made to the amino acids of the Fc chain to reduce the affinity and avidity of the Fc chain and, thus, the bispecific antibody molecule of the invention, for one or more FcγR receptors. In a specific embodiment, the invention encompasses bispecific antibodies comprising a variant Fc chain, or portion thereof, wherein the variant Fc chain comprises at least one amino acid modification relative to a wild-type Fc chain which variant Fc region only binds one FcγR, wherein the FcγR is FcγRIIIA. In another specific embodiment, the invention encompasses bispecific antibodies comprising a variant Fc chain, or portion thereof, wherein the variant Fc chain comprises at least one amino acid modification relative to a wild type Fc chain which variant Fc region only binds one FcγR, wherein the FcγR is FcγRIIA. In another specific embodiment, the invention encompasses bispecific antibodies comprising a variant Fc chain or portion thereof, wherein the variant Fc chain comprises at least one amino acid modification relative to a wild-type Fc chain, which variant Fc chain only binds one FcγR, wherein the FcγR is FcγRIIB. In another embodiment, the invention encompasses molecules comprising a variant Fc chain wherein the variant confers or mediates decreased ADCC activity (or other effector function) and/or an increased binding to FcγRIIB (CD32B), relative to a molecule comprising no Fc chain or comprising a wild-type Fc chain, as measured using methods known to one skilled in the art and described herein.

The invention also encompasses the use of an Fc region comprising domains or regions from two or more IgG isotypes. As known in the art, amino acid modification of the Fc region may profoundly affect Fc-mediated effector function and/or binding activity. However, these alterations in functional characteristics may be further refined and/or manipulated when implemented in the context of selected IgG isotypes. Similarly, the native characteristics of the isotype Fc may be manipulated by one or more amino acid modifications. The multiple IgG isotypes (i.e., IgG1, IgG2, IgG3 and IgG4) exhibit differing physical and functional properties including serum half-life, complement fixation, FcγR binding affinities and effector function activities (e.g., ADCC, CDC) due to differences in the amino acid sequences of their hinge and/or Fc regions.

In one embodiment, the amino acid modification and IgG Fc region are independently selected based on their respective, separate binding and/or effector function activities in order to engineer a bispecific antibody with desired characteristics. In a particular embodiment, the amino acid modifications and IgG hinge/Fc regions have been separately assayed for binding and/or effector function activity as described herein or known in the art in the context of an IgG1. In one embodiment, the amino acid modification and IgG hinge/Fc region display similar functionality, e.g., decreased ADCC activity (or other effector function) and/or an increased binding to FcγRIIB in the context of the bispecific antibody or other Fc-containing molecule (e.g., and immunoglobulin). In another embodiment, the invention encompasses variant Fc regions comprising combinations of amino acid modifications known in the art and selected IgG regions that exhibit novel properties, which properties were not detectable when the modifications and/or regions were independently assayed as described herein.

In some embodiments, the first heterodimer-promoting domain and the second heterodimer-promoting domain each comprise an Fc region comprising a CH2 domain and a CH3 domain, wherein the amino acid sequence of each of the CH2 domain and/or the CH3 comprises at least one amino acid modification as compared to wildtype Fc region, to form a knob or a hole.

In some embodiments, the first heterodimer-promoting domain and the second heterodimer-promoting domain each comprise a CH2 domain and a CH3 domain, wherein the amino acid sequence of each of the CH2 domains and/or each of the CH3 domains is modified to drive heterodimerization and/or stabilize the bispecific antibody In some such embodiments, the bispecific antibodies of the present invention comprise a first heterodimer-promoting domain on the first polypeptide chain and a second heterodimer-promoting domain on the second polypeptide chain. Taken together, the first and second heterodimer-promoting domains drive heterodimerization and/or stabilize the bispecific antibody (e.g., by interaction of a knob and hole on complementary heterodimer-promoting domains) and/or serve to stabilize the bispecific antibody.

In some embodiments, the first heterodimer-promoting domain and the second heterodimer-promoting domain are not both knobs or both holes; and/or wherein the first heterodimer-promoting domain and the second heterodimer-promoting domain form an IgG immunoglobulin Fc region.

In some embodiments, the first heterodimer-promoting domain may comprise an Fc chain having a CH2 and/or CH3 domain modified to comprise either a knob (protuberance) or a hole (cavity). In some such embodiments, the amino acid sequence of the CH2 domain and/or the CH3 domain comprises at least one amino acid modification, wherein: (a) the CH3 domain of the first heterodimer-promoting domain forms a knob; and (b) the CH3 domain of the second heterodimer-promoting domain forms a hole. In another such embodiment, the CH3 domain of the first heterodimer-promoting domain comprises mutations Y349C and/or T366W, to form a knob; and the CH3 domain of the second heterodimer-promoting domain comprises mutations S354C, T366S, L368A, and/or Y407V, to form a hole, (numbering according to the EU index). In some specific embodiments, the mutations lead to a reduced effector function.

In some embodiments, the first heterodimer-promoting domain may comprise a CH2 and/or CH3 domain modified to comprise a knob (protuberance) comprising a sequence of SEQ ID NO: 188, if the second heterodimer-promoting domain comprise a CH2 and/or CH3 domain modified to comprise a hole (cavity). In another embodiment, the first heterodimer-promoting domain may comprise a hole (cavity), if the second heterodimer-promoting domain comprise a CH2 and/or CH3 domain modified to comprise a knob (protuberance). In a particular embodiment of each of the foregoing, the first heterodimer-promoting domain comprises a sequence of SEQ ID NO: 188, to form a knob; and wherein the second heterodimer-promoting domain comprises a sequence of SEQ ID NO: 189, to form a hole. Table 7 provides the amino acid sequences for the knob and hole Fc chains and the first polypeptide chains and second polypeptide chains of the GUCY2c bispecific antibodies with the various GUCY2c and CD3 antibodies described herein (SEQ ID NOs: 196, 197, 199, 200, 202, 203, 205, 206, 210, 211, 216, 217, 219, 220, 248, 249, 282, 283, 284, 285, 286 and 287).

TABLE 7

Knob Fc chain APEAAGAPSVFLFPPKPKDTLMISRTPEVTCVVVDVSHEDPEVKFNW
(SEQ ID NO: YVDGVEVHNAKTKPREEQYNSTYRVVSVLTVLHQDWLNGKEYKCK
188) VSNKALPAPIEKTISKAKGQPREPQVCTLPPSREEMTKNQVSLWCLV
KGFYPSDIAVEWESNGQPENNYKTTPPVLDSDGSFFLYSKLTVDKS
RWQQGNVFSCSVMHEALHNHYTQKSLSLSPG Hole Fc chain APEAAGAPSVFLFPPKPKDTLMISRTPEVTCVVVDVSHEDPEVKFNW
(SEQ ID NO: YVDGVEVHNAKTKPREEQYNSTYRVVSVLTVLHQDWLNGKEYKCK
189) VSNKALPAPIEKTISKAKGQPREPQVYTLPPCREEMTKNQVSLSCAV
KGFYPSDIAVEWESNGQPENNYKTTPPVLDSDGSFFLVSKLTVDKS
RWQQGNVFSCSVMHEALHNHYTQKSLSLSPG TABLE 7-continued

| | |
|---|---|
| GUCY2C-0074_Knob (SEQ ID NO: 196) | DIVLTQSPASLAVSLGQRATISCRASESVDNYGISFMNWFQQKPGQP PKLLIYAASNPGSGVPARFSGSGSGTDFSLNIHPLEEDDTAMFFCQQ SKEVPYTFGGGTKLEIKGGGSGGGGEVQLVESGGGLVQPGGSLRL SCAASGFTFSDYYMTWVRQAPGKGLEWVAFIRNRARGYTSDHNPS VKGRFTISRDNAKNSLYLQMNSLRAEDTAVYYCARDRPSYYVLDYW GQGTTVTVSSGCPPCPAPEAAGAPSVFLFPPKPKDTLMISRTPEVTC VVVDVSHEDPEVKFNWYVDGVEVHNAKTKPREEQYNSTYRWSVL TVLHQDWLNGKEYKCKVSNKALPAPIEKTISKAKGQPREPQVCTLPP SREEMTKNQVSLWCLVKGFYPSDIAVEWESNGQPENNYKTTPPVLD SDGSFFLYSKLTVDKSRWQQGNVFSCSVMHEALHNHYTQKSLSLSPG |
| GUCY2C-0074_Hole (SEQ ID NO: 197) | DIVMTQSPDSLAVSLGERATINCKSSQSLFNVRSRKNYLAWYQQKP GQPPKLLISWASTRESGVPDRFSGSGSGTDFTLTISSLQAEDVAVYY CKQSYDLFTFGSGTKLEIKGGGSGGGGEVQLQQSGAELARPGASV NLSCKASGYTFTTYWMQWVKQRPGQGLEWIGAIYPGDGMTTYTQK FKDKATLTADKSSTAYMQLSSLASEDSAVYYCVRKGMDYWGQGT SVTVSSGCPPCPAPEAAGAPSVFLFPPKPKDTLMISRTPEVTCVVVD VSHEDPEVKFNWYVDGVEVHNAKTKPREEQYNSTYRVVSVLTVLH QDWLNGKEYKCKVSNKALPAPIEKTISKAKGQPREPQVYTLPPCREE MTKNQVSLSCAVKGFYPSDIAVEWESNGQPENNYKTTPPVLDSDGS FFLVSKLTVDKSRWQQGNVFSCSVMHEALHNHYTQKSLSLSPG |
| GUCY2C-0098_Knob (SEQ ID NO: 199) | DIVLTQSPASLAVSLGQRATISCRASESVDYYGTSLMQWYQQKPGQ PPKLLIYAASNVESGVPARFSGSGSGTDFSLNIHPVEEDDIAMYFCQ QTRKVYTFGGGTKLEIKGGGSGGGGEVQLVESGGGLVQPGGSLRL SCAASGFTFSDYYMTWVRQAPGKGLEWVAFIRNRARGYTSDHNPS VKGRFTISRDNAKNSLYLQMNSLRAEDTAVYYCARDRPSYYVLDYW GQGTTVTVSSGCPPCPAPEAAGAPSVFLFPPKPKDTLMISRTPEVTC VVVDVSHEDPEVKFNWYVDGVEVHNAKTKPREEQYNSTYRWSVL TVLHQDWLNGKEYKCKVSNKALPAPIEKTISKAKGQPREPQVCTLPP SREEMTKNQVSLWCLVKGFYPSDIAVEWESNGQPENNYKTTPPVLD SDGSFFLYSKLTVDKSRWQQGNVFSCSVMHEALHNHYTQKSLSLSPG |
| GUCY2C-0098_Hole (SEQ ID NO: 200) | DIVMTQSPDSLAVSLGERATINCKSSQSLFNVRSRKNYLAWYQQKP GQPPKLLISWASTRESGVPDRFSGSGSGTDFTLTISSLQAEDVAVYY CKQSYDLFTFGSGTKLEIKGGGSGGGGQVQLQQSGAELVKPGASV KLSCKASGYTFTSYWMHWVKQRPGQGLEWIGEIKPSNGLTNYIEKF KNKATLTVDKSATTAYMQLSSLTAEDSAVYYCTRTITTTEGYWFFDV WGAGTTVTVSSGCPPCPAPEAAGAPSVFLFPPKPKDTLMISRTPEV TCVVVDVSHEDPEVKFNWYVDGVEVHNAKTKPREEQYNSTYRVVS VLTVLHQDWLNGKEYKCKVSNKALPAPIEKTISKAKGQPREPQVYTL PPCREEMTKNQVSLSCAVKGFYPSDIAVEWESNGQPENNYKTTPPV LDSDGSFFLVSKLTVDKSRWQQGNVFSCSVMHEALHNHYTQKSLSL SPG |
| GUCY2C-0105_Knob (SEQ ID NO: 202) | DIVMTQSPSSLAVSVGEKVTVSCKSSQSLLYSSNQKNYLAWYQQRP GQSPKLLIYWASTRESGVPDRFTGSGSGTDFTLSISSVKAEDLAVYY CQQYYSYPTFGGGTKLEIKGGGSGGGGEVQLVESGGGLVQPGGSL RLSCAASGFTFSDYYMTWVRQAPGKGLEWVAFIRNRARGYTSDHN PSVKGRFTISRDNAKNSLYLQMNSLRAEDTAVYYCARDRPSYYVLD YWGQGTTVTVSSGCPPCPAPEAAGAPSVFLFPPKPKDTLMISRTPE VTCVVVDVSHEDPEVKFNWYVDGVEVHNAKTKPREEQYNSTYRW SVLTVLHQDWLNGKEYKCKVSNKALPAPIEKTISKAKGQPREPQVCT LPPSREEMTKNQVSLWCLVKGFYPSDIAVEWESNGQPENNYKTTPP VLDSDGSFFLYSKLTVDKSRWQQGNVFSCSVMHEALHNHYTQKSL SLSPG |
| GUCY2C-0105_Hole (SEQ ID NO: 203) | DIVMTQSPDSLAVSLGERATINCKSSQSLFNVRSRKNYLAWYQQKP GQPPKLLISWASTRESGVPDRFSGSGSGTDFTLTISSLQAEDVAVYY CKQSYDLFTFGSGTKLEIKGGGSGGGGEVQLQQSGPELVKPGASV KISCKASGYSFTDYIMLWVKQSHGKSLEWIGNSNPYYGSTSYNLKFK GKATLTVDKSSSTAYMHLNSLTSEDSAVYYCARSGYYGSSPYWYFD VWGAGTTVTVSSGCPPCPAPEAAGAPSVFLFPPKPKDTLMISRTPE VTCVVVDVSHEDPEVKFNWYVDGVEVHNAKTKPREEQYNSTYRW SVLTVLHQDWLNGKEYKCKVSNKALPAPIEKTISKAKGQPREPQVYT LPPCREEMTKNQVSLSCAVKGFYPSDIAVEWESNGQPENNYKTTPP VLDSDGSFFLVSKLTVDKSRWQQGNVFSCSVMHEALHNHYTQKSL SLSPG |
| GUCY2C-0240_Knob (SEQ ID NO: 205) | DIQLTQSPSSLSASVGDRVTITCRASESVDNYGISFMNWFQQKPGKA PKLLIYAASNPGSGVPSRFSGSGSGTDFTLTISSLQPEDFATYYCQQ SKEVPYTFGQGTKLEIKGGGSGGGGEVQLVESGGGLVQPGGSLRL SCAASGFTFSDYYMTWVRQAPGKGLEWVAFIRNRARGYTSDHNPS VKGRFTISRDNAKNSLYLQMNSLRAEDTAVYYCARDRPSYYVLDYW GQGTTVTVSSGCPPCPAPEAAGAPSVFLFPPKPKDTLMISRTPEVTC VVVDVSHEDPEVKFNWYVDGVEVHNAKTKPREEQYNSTYRWSVL TVLHQDWLNGKEYKCKVSNKALPAPIEKTISKAKGQPREPQVCTLPP SREEMTKNQVSLWCLVKGFYPSDIAVEWESNGQPENNYKTTPPVLD SDGSFFLYSKLTVDKSRWQQGNVFSCSVMHEALHNHYTQKSLSLSPG |

TABLE 7-continued

| | |
|---|---|
| GUCY2C-0240_Hole (SEQ ID NO: 206) | DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLVESGGGLVQPGGSLRLSCAASGYTFTTYWMQWVRQAPGKGLEWIGAIYPGDGMTTYTQKFKDRFTISADKAKNSAYLQMNSLRAEDTAVYYCVRKGMDYWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| GUCY2C-0247_Knob (SEQ ID NO: 210) | DIQLTQSPSSLSASVGDRVTITCRASESVDYYGTSLMQWYQQKPGKPPKLLIYAASNVESGVPSRFSGSGSGTDFTLTISSLQPEDFATYYCQQTRKVYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |
| GUCY2C-0247_Hole (SEQ ID NO: 211) | DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| GUCY2C-1478_Knob; GUCY2C-1608_Knob (SEQ ID NO: 216) | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |
| GUCY2C-1478_Hole (SEQ ID NO: 217) | DIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIKGGGGSGGGGEVQLVESGGGLVQPGGSLRLSCAASGYTFTSYWMHWVRQAPGKGLEWIGEIKPSNGLTNVHEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| GUCY2C-1608_Hole (SEQ ID NO: 220) | DIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| GUCY2C-0250_Knob (SEQ ID NO: 248) | DIQLTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |

TABLE 7-continued

| | |
|---|---|
| GUCY2C-0250_Hole (SEQ ID NO: 249) | DIQMTQSPSSLSASVGDRVTITCTSSQSLFNVRSRKNYLAWYQQKPGKAPKLLIYWASTRESGVPSRFSGSGSGTDFTLTISSLQPEDFATYYCKQSYDLFTFGGGTKVEIKGGGSGGGGEVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| GUCY2C-1678_Knob (SEQ ID NO: 282) | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |
| GUCY2C-1678_Hole (SEQ ID NO: 283) | DIQMTQSPSSLSASVGDRVTITCTSDQSLFNVRSGKNYLAWYQQKPGKAPKLLIYWASDRESGVPSRFSGSGSGTDFTLTISSLQPEDFATYYCKQSYDLFTFGGGTKVEIKGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| GUCY2C-1679_Knob (SEQ ID NO: 284) | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |
| GUCY2C-1679_Hole (SEQ ID NO: 285) | DIQMTQSPSSLSASVGDRVTITCTSSQSLFNVRSGKNYLAWYQQKPGKAPKLLIYWASDRESGVPSRFSGSGSGTDFTLTISSLQPEDFATYYCKQSYDLFTFGGGTKVEIKGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| GUCY2C-1680_Knob (SEQ ID NO: 286) | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |
| GUCY2C-1680_Hole (SEQ ID NO: 287) | DIQMTQSPSSLSASVGDRVTITCTSSESLFNVRSGKNYLAWYQQKPGKAPKLLIYWASDRESGVPSRFSGSGSGTDFTLTISSLQPEDFATYYCKQSYDLFTFGGGTKVEIKGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFD |

TABLE 7-continued

```
VWGQGTLVTVSSGCPPCPAPEAAGAPSVFLFPPKPKDTLMISRTPE
VTCVVVDVSHEDPEVKFNWYVDGVEVHNAKTKPREEQYNSTYRVV
SVLTVLHQDWLNGKEYKCKVSNKALPAPIEKTISKAKGQPREPQVYT
LPPCREEMTKNQVSLSCAVKGFYPSDIAVEWESNGQPENNYKTTPP
VLDSDGSFFLVSKLTVDKSRWQQGNVFSCSVMHEALHNHYTQKSL
SLSPG
```

One way of determining binding affinity of antibodies to GUCY2c or CD3 is by measuring binding affinity of monofunctional Fab fragments of the antibody. To obtain monofunctional Fab fragments, an antibody (e.g., IgG) can be cleaved with papain or expressed recombinantly. The affinity of a GUCY2c Fab fragment of an antibody can be determined by surface plasmon resonance (BIACORE™ 3000™ surface plasmon resonance (SPR) system, BIACORE™, INC, Piscataway N.J.) equipped with pre-immobilized streptavidin Sensor Chips (SA) or anti-mouse Fc or anti-human Fc using HBS-EP running buffer (0.01M HEPES, pH 7.4, 0.15 M NaCl, 3 mM EDTA, 0.005% v/v Surfactant P20). Biotinylated or Fc fusion human GUCY2c can be diluted into HBS-EP buffer to a concentration of less than 0.5 µg/mL and injected across the individual chip channels using variable contact times, to achieve two ranges of antigen density, either 50-200 response units (RU) for detailed kinetic studies or 800-1,000 RU for screening assays. Regeneration studies have shown that 25 mM NaOH in 25% v/v ethanol effectively removes the bound Fab while keeping the activity of GUCY2c on the chip for over 200 injections. Typically, serial dilutions (spanning concentrations of 0.1-10× estimated $K_D$) of purified Fab samples are injected for 1 min at 100 µL/minute and dissociation times of up to 2 hours are allowed. The concentrations of the Fab proteins are determined by ELISA and/or SDS-PAGE electrophoresis using a Fab of known concentration (as determined by amino acid analysis) as a standard. Kinetic association rates ($k_{on}$) and dissociation rates ($k_{off}$) are obtained simultaneously by fitting the data globally to a 1:1 Langmuir binding model (Karlsson, R. Roos, H. Fagerstam, L. Petersson, B., Methods Enzymology 6. 99-110, 1994) using the BIAevaluation program. Equilibrium dissociation constant ($K_D$) values are calculated as $k_{off}/k_{on}$. This protocol is suitable for use in determining binding affinity of an antibody to any GUCY2c, including human GUCY2c, GUCY2c of another mammal (such as mouse GUCY2c, rat GUCY2c, or primate GUCY2c), as well as different forms of GUCY2c (e.g., glycosylated GUCY2c). Binding affinity of an antibody is generally measured at 25° C., but can also be measured at 37° C.

The antibodies as described herein may be made by any method known in the art. For the production of hybridoma cell lines, the route and schedule of immunization of the host animal are generally in keeping with established and conventional techniques for antibody stimulation and production, as further described herein. General techniques for production of human and mouse antibodies are known in the art and/or are described herein.

It is contemplated that any mammalian subject including humans or antibody producing cells therefrom can be manipulated to serve as the basis for production of mammalian, including human and hybridoma cell lines. Typically, the host animal is inoculated intraperitoneally, intramuscularly, orally, subcutaneously, intraplantar, and/or intradermally with an amount of immunogen, including as described herein.

Hybridomas can be prepared from the lymphocytes and immortalized myeloma cells using the general somatic cell hybridization technique of Kohler, B. and Milstein, C., Nature 256:495-497, 1975 or as modified by Buck, D. W., et al., In Vitro, 18:377-381, 1982. Available myeloma lines, including but not limited to X63-Ag8.653 and those from the Salk Institute, Cell Distribution Center, San Diego, Calif., USA, may be used in the hybridization. Generally, the technique involves fusing myeloma cells and lymphoid cells using a fusogen such as polyethylene glycol, or by electrical means well known to those skilled in the art. After the fusion, the cells are separated from the fusion medium and grown in a selective growth medium, such as hypoxanthine-aminopterin-thymidine (HAT) medium, to eliminate unhybridized parent cells. Any of the media described herein, supplemented with or without serum, can be used for culturing hybridomas that secrete monoclonal antibodies. As another alternative to the cell fusion technique, EBV immortalized B cells may be used to produce the monoclonal antibodies of the subject invention. The hybridomas are expanded and subcloned, if desired, and supernatants are assayed for anti-immunogen activity by conventional immunoassay procedures (e.g., radioimmunoassay, enzyme immunoassay, or fluorescence immunoassay).

Hybridomas that may be used as source of antibodies encompass all derivatives, progeny cells of the parent hybridomas that produce monoclonal antibodies specific for GUCY2c, CD3, or portions thereof.

Hybridomas that produce such antibodies may be grown in vitro or in vivo using known procedures. The monoclonal antibodies may be isolated from the culture media or body fluids, by conventional immunoglobulin purification procedures such as ammonium sulfate precipitation, gel electrophoresis, dialysis, chromatography, and so ultrafiltration, if desired. Undesired activity, if present, can be removed, for example, by running the preparation over adsorbents made of the immunogen attached to a solid phase and eluting or releasing the desired antibodies off the immunogen. Immunization of a host animal with a human GUCY2c or CD3, or a fragment containing the target amino acid sequence conjugated to a protein that is immunogenic in the species to be immunized, e.g., keyhole limpet hemocyanin, serum albumin, bovine thyroglobulin, or soybean trypsin inhibitor using a bifunctional or derivatizing agent, for example, maleimidobenzoyl sulfosuccinimide ester (conjugation through cysteine residues), N-hydroxysuccinimide (through lysine residues), glutaraldehyde, succinic anhydride, $SOCl_2$, or $R^1N=C=NR$, where R and $R^1$ are different alkyl groups, can yield a population of antibodies (e.g., monoclonal antibodies).

If desired, the antibody (monoclonal or polyclonal) of interest may be sequenced and the polynucleotide sequence may then be cloned into a vector for expression or propagation. The sequence encoding the antibody of interest may be maintained in vector in a host cell and the host cell can then be expanded and frozen for future use. Production of recombinant monoclonal antibodies in cell culture can be carried out through cloning of antibody genes from B cells by means known in the art. See, e.g., Tiller et al., J. Immunol. Methods, 329, 112, 2008; U.S. Pat. No. 7,314,622.

In an alternative, the polynucleotide sequence may be used for genetic manipulation to humanize the antibody or to improve the affinity, or other characteristics of the antibody. For example, the constant region may be engineered to more nearly resemble human constant regions to avoid immune response if the antibody is used in clinical trials and treatments in humans. It may be desirable to genetically manipulate the antibody sequence to obtain greater affinity to GUCY2c or CD3 and greater efficacy in inhibiting GUCY2c.

There are four general steps to humanize a monoclonal antibody. These are: (1) determining the nucleotide and predicted amino acid sequence of the starting antibody light and heavy variable regions (2) designing the humanized antibody, i.e., deciding which antibody framework region to use during the humanizing process (3) the actual humanizing methodologies/techniques and (4) the transfection and expression of the humanized antibody. See, for example, U.S. Pat. Nos. 4,816,567; 5,807,715; 5,866,692; 6,331,415; 5,530,101; 5,693,761; 5,693,762; 5,585,089; and 6,180,370.

A number of humanized antibody molecules comprising an antigen binding site derived from a non-human immunoglobulin have been described, including chimeric antibodies having rodent or modified rodent V regions and their associated CDRs fused to human constant regions. See, for example, Winter et al. Nature 349:293-299, 1991, Lobuglio et al. Proc. Nat. Acad. Sci. USA 86:4220-4224, 1989, Shaw et al. J Immunol. 138:4534-4538, 1987, and Brown et al. Cancer Res. 47:3577-3583, 1987. Other references describe rodent CDRs grafted into a human supporting framework region (FR) prior to fusion with an appropriate human antibody constant region. See, for example, Riechmann et al. Nature 332:323-327, 1988, Verhoeyen et al. Science 239:1534-1536, 1988, and Jones et al. Nature 321:522-525, 1986. Another reference describes rodent CDRs supported by recombinantly engineered rodent framework regions. See, for example, European Publication No. EP0519596. These "humanized" molecules are designed to minimize unwanted immunological response toward rodent anti-human antibody molecules which limits the duration and effectiveness of therapeutic applications of those moieties in human recipients. For example, the antibody constant region can be engineered such that it is immunologically inert (e.g., does not trigger complement lysis). See, e.g., PCT Application No. PCT/GB99/01441; UK Application No. 9809951.8. Other methods of humanizing antibodies that may also be utilized are disclosed by Daugherty et al., Nucl. Acids Res. 19:2471-2476, 1991, and in U.S. Pat. Nos. 6,180,377; 6,054,297; 5,997,867; 5,866,692; 6,210,671; and 6,350,861; and in PCT Publication No. WO01/27160.

The general principles related to humanized antibodies discussed above are also applicable to customizing antibodies for use, for example, in dogs, cats, primate, equines and bovines. Further, one or more aspects of humanizing an antibody described herein may be combined, e.g., CDR grafting, framework mutation and CDR mutation.

In one variation, fully human antibodies may be obtained by using commercially available mice that have been engineered to express specific human immunoglobulin proteins. Transgenic animals that are designed to produce a more desirable (e.g., fully human antibodies) or more robust immune response may also be used for generation of humanized or human antibodies. Examples of such technology are Xenomouse™ from Abgenix, Inc. (Fremont, Calif.) and HuMAb-Mouse® and TC Mouse™ from Medarex, Inc. (Princeton, N.J.).

In an alternative, antibodies may be made recombinantly and expressed using any method known in the art. In another alternative, antibodies may be made recombinantly by phage display technology. See, for example, U.S. Pat. Nos. 5,565,332; 5,580,717; 5,733,743; and 6,265,150; and Winter et al., Annu. Rev. Immunol. 12:433-455, 1994. Alternatively, the phage display technology (McCafferty et al., Nature 348:552-553, 1990) can be used to produce human antibodies and antibody fragments in vitro, from immunoglobulin variable (V) domain gene repertoires from unimmunized donors. According to this technique, antibody V domain genes are cloned in-frame into either a major or minor coat protein gene of a filamentous bacteriophage, such as M13 or fd, and displayed as functional antibody fragments on the surface of the phage particle. Because the filamentous particle contains a single-stranded DNA copy of the phage genome, selections based on the functional properties of the antibody also result in selection of the gene encoding the antibody exhibiting those properties. Thus, the phage mimics some of the properties of the B cell. Phage display can be performed in a variety of formats; for review see, e.g., Johnson, Kevin S. and Chiswell, David J., Current Opinion in Structural Biology 3:564-571, 1993. Several sources of V-gene segments can be used for phage display. Clackson et al., Nature 352:624-628, 1991, isolated a diverse array of anti-oxazolone antibodies from a small random combinatorial library of V genes derived from the spleens of immunized mice. A repertoire of V genes from unimmunized human donors can be constructed and antibodies to a diverse array of antigens (including self-antigens) can be isolated essentially following the techniques described by Mark et al., J. Mol. Biol. 222:581-597, 1991, or Griffith et al., EMBO J. 12:725-734, 1993. In a natural immune response, antibody genes accumulate mutations at a high rate (somatic hypermutation). Some of the changes introduced will confer higher affinity, and B cells displaying high-affinity surface immunoglobulin are preferentially replicated and differentiated during subsequent antigen challenge. This natural process can be mimicked by employing the technique known as "chain shuffling" (Marks et al., Bio/Technol. 10:779-783, 1992). In this method, the affinity of "primary" human antibodies obtained by phage display can be improved by sequentially replacing the heavy and light chain V region genes with repertoires of naturally occurring variants (repertoires) of V domain genes obtained from unimmunized donors. This technique allows the production of antibodies and antibody fragments with affinities in the pM-nM range. A strategy for making very large phage antibody repertoires (also known as "the mother-of-all libraries") has been described by Waterhouse et al., Nucl. Acids Res. 21:2265-2266, 1993. Gene shuffling can also be used to derive human antibodies from rodent antibodies, where the human antibody has similar affinities and specificities to the starting rodent antibody. According to this method, which is also referred to as "epitope imprinting", the heavy or light chain V domain gene of rodent antibodies obtained by phage display technique is replaced with a repertoire of human V domain genes, creating rodent-human chimeras. Selection on antigen results in isolation of human variable regions capable of restoring a functional antigen binding site, i.e., the epitope governs (imprints) the choice of partner. When the process is repeated in order to replace the remaining rodent V domain, a human antibody is obtained (see PCT Publication No. WO93/06213). Unlike traditional humanization of rodent antibodies by CDR grafting, this technique provides completely human antibodies, which have no framework or CDR residues of rodent origin.

Antibodies may be made recombinantly by first isolating the antibodies and antibody producing cells from host animals, obtaining the gene sequence, and using the gene sequence to express the antibody recombinantly in host cells (e.g., CHO cells). Another method which may be employed is to express the antibody sequence in plants (e.g., tobacco) or transgenic milk. Methods for expressing antibodies recombinantly in plants or milk have been disclosed. See, for example, Peeters, et al. Vaccine 19:2756, 2001; Lonberg, N. and D. Huszar Int. Rev. Immunol 13:65, 1995; and Pollock, et al., J Immunol Methods 231:147, 1999. Methods for making derivatives of antibodies, e.g., humanized, single chain, etc. are known in the art.

Immunoassays and flow cytometry sorting techniques such as fluorescence activated cell sorting (FACS) can also be employed to isolate antibodies that are specific for GUCY2c, CD3, or antigens of interest.

The antibodies as described herein can be bound to many different solid phase supports or carriers. Such supports can be active and/or inert. Well-known supports include polypropylene, polystyrene, polyethylene, dextran, nylon, amylases, glass, natural and modified celluloses, polyacrylamides, agaroses, and magnetite. The nature of the support can be either soluble or insoluble for purposes of the invention. Those skilled in the art will know of other suitable supports for binding antibodies, or will be able to ascertain such, using routine experimentation. In some embodiments, the support comprises a moiety that targets the myocardium.

DNA encoding the monoclonal antibodies is readily isolated and sequenced using conventional procedures (e.g., by using oligonucleotide probes that are capable of binding specifically to genes encoding the heavy and light chains of the monoclonal antibodies). The hybridoma cells serve as a preferred source of such DNA. Once isolated, the DNA may be placed into expression vectors (such as expression vectors disclosed in PCT Publication No. WO87/04462), which are then transfected into host cells such as *E. coli* cells, simian COS cells, CHO cells, or myeloma cells that do not otherwise produce immunoglobulin protein, to obtain the synthesis of monoclonal antibodies in the recombinant host cells. See, e.g., PCT Publication No. WO87/04462. The DNA also may be modified, for example, by substituting the coding sequence for human heavy and light chain constant regions in place of the homologous murine sequences, Morrison et al., Proc. Nat. Acad. Sci. 81:6851, 1984, or by covalently joining to the immunoglobulin coding sequence all or part of the coding sequence for a non-immunoglobulin polypeptide. In that manner, "chimeric" or "hybrid" antibodies are prepared that have the binding specificity of a monoclonal antibody herein.

The GUCY2c, CD3, or other antigen antibodies as described herein can be identified or characterized using methods known in the art, whereby reduction of GUCY2c, CD3, or other antigen expression levels are detected and/or measured. In some embodiments, a GUCY2c antibody is identified by incubating a candidate agent with GUCY2c and monitoring binding and/or attendant reduction of GUCY2c expression levels. The binding assay may be performed with purified GUCY2c polypeptide(s), or with cells naturally expressing, or transfected to express, GUCY2c polypeptide(s). In one embodiment, the binding assay is a competitive binding assay, where the ability of a candidate antibody to compete with a known GUCY2c antibody for GUCY2c binding is evaluated. The assay may be performed in various formats, including the ELISA format.

Following initial identification, the activity of a candidate GUCY2c, CD3, or other antigen antibody can be further confirmed and refined by bioassays, known to test the targeted biological activities. Alternatively, bioassays can be used to screen candidates directly. Some of the methods for identifying and characterizing antibodies are described in detail in the Examples.

GUCY2c, CD3, or other antigen antibodies may be characterized using methods well known in the art. For example, one method is to identify the epitope to which it binds, or epitope mapping. There are many methods known in the art for mapping and characterizing the location of epitopes on proteins, including solving the crystal structure of an antibody-antigen complex, competition assays, gene fragment expression assays, and synthetic peptide-based assays, as described, for example, in Chapter 11 of Harlow and Lane, Using Antibodies, a Laboratory Manual, Cold Spring Harbor Laboratory Press, Cold Spring Harbor, N.Y., 1999. In an additional example, epitope mapping can be used to determine the sequence to which an antibody binds. Epitope mapping is commercially available from various sources, for example, Pepscan Systems (Edelhertweg 15, 8219 PH Lelystad, The Netherlands). The epitope can be a linear epitope, i.e., contained in a single stretch of amino acids, or a conformational epitope formed by a three-dimensional interaction of amino acids that may not necessarily be contained in a single stretch. Peptides of varying lengths (e.g., at least 4-6 amino acids long) can be isolated or synthesized (e.g., recombinantly) and used for binding assays with a GUCY2c, CD3, or other antigen antibody. In another example, the epitope to which the GUCY2c, CD3, or other antigen antibody binds can be determined in a systematic screening by using overlapping peptides derived from the GUCY2c, CD3, or other antigen sequence and determining binding by the GUCY2c, CD3, or other antigen antibody. According to the gene fragment expression assays, the open reading frame encoding GUCY2c, CD3, or other antigen is fragmented either randomly or by specific genetic constructions and the reactivity of the expressed fragments of GUCY2c, CD3, or other antigen with the antibody to be tested is determined. The gene fragments may, for example, be produced by PCR and then transcribed and translated into protein in vitro, in the presence of radioactive amino acids. The binding of the antibody to the radioactively labeled GUCY2c, CD3, or other antigen fragments is then determined by immunoprecipitation and gel electrophoresis. Certain epitopes can also be identified by using large libraries of random peptide sequences displayed on the surface of phage particles (phage libraries). Alternatively, a defined library of overlapping peptide fragments can be tested for binding to the test antibody in simple binding assays. In an additional example, mutagenesis of an antigen binding domain, domain swapping experiments and alanine scanning mutagenesis can be performed to identify residues required, sufficient, and/or necessary for epitope binding. For example, domain swapping experiments can be performed using a mutant GUCY2c, CD3, or other antigen in which various fragments of the GUCY2c, CD3, or other antigen protein have been replaced (swapped) with sequences from GUCY2c from another species (e.g., mouse), or a closely related, but antigenically distinct protein (e.g., Trop-1). By assessing binding of the antibody to the mutant GUCY2c, CD3, or other antigen, the importance of the particular GUCY2c, CD3, or other antigen fragment to antibody binding can be assessed.

Yet another method which can be used to characterize a GUCY2c, CD3, or other antigen antibody is using competition assays with other antibodies known to bind to the same antigen, i.e., various fragments on GUCY2c, CD3, or other antigen, to determine if the GUCY2c, CD3, or other antigen antibody binds to the same epitope as other antibodies, respectively. Competition assays are well known to those of skill in the art.

An expression vector can be used to direct expression of a GUCY2c, CD3, or other antigen antibody. One skilled in the art is familiar with administration of expression vectors to obtain expression of an exogenous protein in vivo. See, e.g., U.S. Pat. Nos. 6,436,908; 6,413,942; and 6,376,471. Administration of expression vectors includes local or systemic administration, including injection, oral administration, particle gun or catheterized administration, and topical administration. In another embodiment, the expression vector is administered directly to the sympathetic trunk or ganglion, or into a coronary artery, atrium, ventricle, or pericardium.

Targeted delivery of therapeutic compositions containing an expression vector, or subgenomic polynucleotides can also be used. Receptor-mediated DNA delivery techniques are described in, for example, Findeis et al., Trends Biotechnol., 11:202, 1993; Chiou et al., Gene Therapeutics: Methods And Applications Of Direct Gene Transfer, J. A. Wolff, ed., 1994; Wu et al., J. Biol. Chem., 263:621, 1988; Wu et al., J. Biol. Chem., 269:542, 1994; Zenke et al., Proc. Natl. Acad. Sci. USA, 87:3655, 1990; and Wu et al., J. Biol. Chem., 266:338, 1991. Therapeutic compositions containing a polynucleotide are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. The therapeutic polynucleotides and polypeptides can be delivered using gene delivery vehicles. The gene delivery vehicle can be of viral or non-viral origin (see generally, Jolly, Cancer Gene Therapy, 1:51, 1994; Kimura, Human Gene Therapy, 5:845, 1994; Connelly, Human Gene Therapy, 1:185, 1995; and Kaplitt, Nature Genetics, 6:148, 1994). Expression of such coding sequences can be induced using endogenous mammalian or heterologous promoters. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., PCT Publication Nos. WO90/07936; WO94/03622; WO93/25698; WO93/25234; WO93/11230; WO93/10218; WO91/02805; U.S. Pat. Nos. 5,219,740 and 4,777,127; GB Pat. No. 2,200,651; and EP Pat. No. EP0 345 242), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532)), and adeno-associated virus (AAV) vectors (see, e.g., PCT Publication Nos. WO94/12649, WO93/03769; WO93/19191; WO94/28938; WO95/11984 and WO95/00655). Administration of DNA linked to killed adenovirus as described in Curiel, Hum. Gene Ther., 3:147, 1992 can also be employed.

Non-viral delivery vehicles and methods can also be employed, including, but not limited to, polycationic condensed DNA linked or unlinked to killed adenovirus alone (see, e.g., Curiel, Hum. Gene Ther., 3:147, 1992); ligand-linked DNA (see, e.g., Wu, J. Biol. Chem., 264:16985, 1989); eukaryotic cell delivery vehicles cells (see, e.g., U.S. Pat. No. 5,814,482; PCT Publication Nos. WO95/07994; WO96/17072; WO95/30763; and WO97/42338) and nucleic charge neutralization or fusion with cell membranes. Naked DNA can also be employed. Exemplary naked DNA introduction methods are described in PCT Publication No. WO90/11092 and U.S. Pat. No. 5,580,859. Liposomes that can act as gene delivery vehicles are described in U.S. Pat. No. 5,422,120; PCT Publication Nos. WO95/13796; WO94/23697; WO91/14445; and European Publication EP 0524968. Additional approaches are described in Philip, Mol. Cell Biol., 14:2411, 1994 and in Woffendin, Proc. Natl. Acad. Sci., 91:1581, 1994.

In some embodiments, the invention encompasses compositions, including pharmaceutical compositions comprising antibodies of the invention as described herein or made by the methods and having the characteristics described herein. As used herein, pharmaceutical compositions may comprise one or more antibodies that bind to GUCY2c, one or more bispecific antibodies that bind to CD3 and a GUCY2c tumor antigen, and/or one or more polynucleotides comprising sequences encoding one or more these antibodies. These compositions may further comprise suitable excipients, such as pharmaceutically acceptable excipients including buffers, which are well known in the art.

The invention also provides methods of making any of these antibodies. The antibodies of this invention can be made by procedures known in the art. The polypeptides can be produced by proteolytic or other degradation of the antibodies, by recombinant methods (i.e., single or fusion polypeptides) as described above or by chemical synthesis. Polypeptides of the antibodies, especially shorter polypeptides up to about 50 amino acids, are conveniently made by chemical synthesis. Methods of chemical synthesis are known in the art and are commercially available. For example, an antibody could be produced by an automated polypeptide synthesizer employing the solid phase method. See also, U.S. Pat. Nos. 5,807,715; 4,816,567; and 6,331,415.

Heteroconjugate antibodies, comprising two covalently joined antibodies, are also within the scope of the invention. Such antibodies have been used to target immune system cells to unwanted cells (U.S. Pat. No. 4,676,980), and for treatment of HIV infection (PCT Publication Nos. WO91/00360 and WO92/200373; and European Pat. Publication EP03089). Heteroconjugate antibodies may be made using any convenient cross-linking methods. Suitable cross-linking agents and techniques are well known in the art, and are described in U.S. Pat. No. 4,676,980.

Chimeric or hybrid antibodies also may be prepared in vitro using known methods of synthetic protein chemistry, including those involving cross-linking agents. For example, immunotoxins may be constructed using a disulfide exchange reaction or by forming a thioether bond. Examples of suitable reagents for this purpose include iminothiolate and methyl-4-mercaptobutyrimidate.

In the recombinant humanized antibodies, the Fcγ portion can be modified to avoid interaction with Fcγ receptor and the complement and immune systems. The techniques for preparation of such antibodies are described in PCT Publication WO99/58572. For example, the constant region may be engineered to more resemble human constant regions to avoid immune response if the antibody is used in clinical trials and treatments in humans. See, for example, U.S. Pat. Nos. 5,997,867 and 5,866,692.

The GUCY2c antibodies and CD3-GUCY2c bispecific antibodies as disclosed herein may comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the VH and/or VL domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived).

Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding affinity, improved or enhanced antagonistic or agonistic biological properties (as the case may be), reduced immunogenicity, etc. Antibodies and antigen-binding fragments obtained in this general manner are encompassed within the present invention.

The present invention also includes GUCY2c antibodies and CD3-GUCY2c bispecific antibodies comprising variants of any of the HC VR, LC VR, and/or CDR amino acid sequences disclosed herein having one or more conservative substitutions. For example, the present invention includes GUCY2c antibodies and CD3-GUCY2c bispecific antibodies having HC VR, LC VR, and/or CDR amino acid sequences with, e.g., 10 or fewer, 8 or fewer, 6 or fewer, 4 or fewer, etc. conservative amino acid substitutions relative to any of the HC VR, LC VR, and/or CDR amino acid sequences, as disclosed herein.

Accordingly, the invention encompasses modifications to the antibodies and polypeptides of the invention variants as described herein, including functionally equivalent antibodies which do not significantly affect their properties and variants which have enhanced or decreased activity and/or affinity. For example, the amino acid sequence may be mutated to obtain an antibody with the desired binding affinity to GUCY2c and/or CD3. Modification of polypeptides is routine practice in the art and need not be described in detail herein. Examples of modified polypeptides include polypeptides with conservative substitutions of amino acid residues, one or more deletions or additions of amino acids which do not significantly deleteriously change the functional activity, or which mature (enhance) the affinity of the polypeptide for its ligand, or use of chemical analogs.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue or the antibody fused to an epitope tag. Other insertional variants of the antibody molecule include the fusion to the N- or C-terminus of the antibody of an enzyme or a polypeptide which increases the half-life of the antibody in the blood circulation.

Substitution variants have at least one amino acid residue in the antibody molecule removed and a different residue inserted in its place. The sites of greatest interest for substitutional mutagenesis include the hypervariable regions, but FR alterations are also contemplated. Conservative substitutions are shown in Table 8 under the heading of "conservative substitutions." If such substitutions result in a change in biological activity, then more substantial changes, denominated "exemplary substitutions" in Table 8, or as further described below in reference to amino acid classes, may be introduced and the products screened.

TABLE 8

| Original Residue (naturally occurring amino acid) | Conservative Substitutions | Exemplary Substitutions |
|---|---|---|
| Ala (A) | Val | Val; Leu; Ile |
| Arg (R) | Lys | Lys; Gln; Asn |
| Asn (N) | Gln | Gln; His; Asp, Lys; Arg |
| Asp (D) | Glu | Glu; Asn |
| Cys (C) | Ser | Ser; Ala |
| Gln (Q) | Asn | Asn; Glu |
| Glu (E) | Asp | Asp; Gln |
| Gly (G) | Ala | Ala |
| His (H) | Arg | Asn; Gln; Lys; Arg |
| Ile (I) | Leu | Leu; Val; Met; Ala; Phe; Norleucine |
| Leu (L) | Ile | Norleucine; Ile; Val; Met; Ala; Phe |
| Lys (K) | Arg | Arg; Gln; Asn |
| Met (M) | Leu | Leu; Phe; Ile |
| Phe (F) | Tyr | Leu; Val; Ile; Ala; Tyr |
| Pro (P) | Ala | Ala |
| Ser (S) | Thr | Thr |
| Thr (T) | Ser | Ser |
| Trp (W) | Tyr | Tyr; Phe |
| Tyr (Y) | Phe | Trp; Phe; Thr; Ser |
| Val (V) | Leu | Ile; Leu; Met; Phe; Ala; Norleucine |

Substantial modifications in the biological properties of the antibody are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring amino acid residues are divided into groups based on common side-chain properties:
(1) Non-polar: Norleucine, Met, Ala, Val, Leu, Ile,
(2) Polar without charge: Cys, Ser, Thr, Asn, Gln;
(3) Acidic (negatively charged): Asp, Glu;
(4) Basic (positively charged): Lys, Arg;
(5) Residues that influence chain orientation: Gly, Pro; and
(6) Aromatic: Trp, Tyr, Phe, His.

Non-conservative substitutions are made by exchanging a member of one of these classes for another class.

Any cysteine residue not involved in maintaining the proper conformation of the antibody also may be substituted, generally with serine, to improve the oxidative stability of the molecule and prevent aberrant cross-linking. Conversely, cysteine bond(s) may be added to the antibody to improve its stability, particularly where the antibody is an antibody fragment such as an Fv fragment.

Amino acid modifications can range from changing or modifying one or more amino acids to complete redesign of a region, such as the variable region. Changes in the variable region can alter binding affinity and/or specificity. In some embodiments, no more than one to five conservative amino acid substitutions are made within a CDR domain. In other embodiments, no more than one to three conservative amino acid substitutions are made within a CDR domain. In still other embodiments, the CDR domain is VH CDR3 and/or VL CDR3.

Modifications also include glycosylated and nonglycosylated polypeptides, as well as polypeptides with other post-translational modifications, such as, for example, glycosylation with different sugars, acetylation, and phosphorylation. Antibodies are glycosylated at conserved positions in their constant regions (Jefferis and Lund, Chem. Immunol. 65:111-128, 1997; Wright and Morrison, TibTECH 15:26-32, 1997). The oligosaccharide side chains of the immunoglobulins affect the protein's function (Boyd et al., Mol. Immunol. 32:1311-1318, 1996; Wittwe and Howard, Biochem. 29:4175-4180, 1990) and the intramolecular interaction between portions of the glycoprotein, which can affect the conformation and presented three-dimensional surface of the glycoprotein (Jefferis and Lund, supra; Wyss and Wagner, Current Opin. Biotech. 7:409-416, 1996). Oligosaccharides may also serve to target a given glycoprotein to certain molecules based upon specific recognition structures. Glycosylation of antibodies has also been reported to affect antibody-dependent cellular cytotoxicity (ADCC). In particular, CHO cells with tetracycline-regulated expression of β(1,4)-N-acetylglucosaminyltransferase III (GnTIII), a glycosyltransferase catalyzing formation of bisecting GlcNAc, was reported to have improved ADCC activity (Umana et al., Mature Biotech. 17:176-180, 1999).

Glycosylation of antibodies is typically either N-linked or O-linked. N-linked refers to the attachment of the carbohydrate moiety to the side chain of an asparagine residue. The tripeptide sequences asparagine-X-serine, asparagine-X-threonine, and asparagine-X-cysteine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. O-linked glycosylation refers to the attachment of one of the sugars N-acetylgalactosamine, galactose, or xylose to a hydroxyamino acid, most commonly serine or threonine, although 5-hydroxyproline or 5-hydroxylysine may also be used.

Addition of glycosylation sites to the antibody is conveniently accomplished by altering the amino acid sequence such that it contains one or more of the above-described tripeptide sequences (for N-linked glycosylation sites). The alteration may also be made by the addition of, or substitution by, one or more serine or threonine residues to the sequence of the original antibody (for O-linked glycosylation sites).

The glycosylation pattern of antibodies may also be altered without altering the underlying nucleotide sequence. Glycosylation largely depends on the host cell used to express the antibody. Since the cell type used for expression of recombinant glycoproteins, e.g., antibodies, as potential therapeutics is rarely the native cell, variations in the glycosylation pattern of the antibodies can be expected (see, e.g., Hse et al., J. Biol. Chem. 272:9062-9070, 1997).

In addition to the choice of host cells, factors that affect glycosylation during recombinant production of antibodies include growth mode, media formulation, culture density, oxygenation, pH, purification schemes and the like. Various methods have been proposed to alter the glycosylation pattern achieved in a particular host organism including introducing or overexpressing certain enzymes involved in oligosaccharide production (U.S. Pat. Nos. 5,047,335; 5,510,261 and 5,278,299). Glycosylation, or certain types of glycosylation, can be enzymatically removed from the glycoprotein, for example, using endoglycosidase H (Endo H), N-glycosidase F, endoglycosidase F1, endoglycosidase F2, endoglycosidase F3. In addition, the recombinant host cell can be genetically engineered to be defective in processing certain types of polysaccharides. These and similar techniques are well known in the art.

Other methods of modification include using coupling techniques known in the art, including, but not limited to, enzymatic means, oxidative substitution and chelation. Modifications can be used, for example, for attachment of labels for immunoassay. Modified polypeptides are made using established procedures in the art and can be screened using standard assays known in the art, some of which are described below and in the Examples.

In some embodiments of the invention, the antibody comprises a modified constant region, such as a constant region that has increased affinity to a human Fc gamma receptor, is immunologically inert or partially inert, e.g., does not trigger complement mediated lysis, does not stimulate antibody-dependent cell mediated cytotoxicity (ADCC), or does not activate macrophages; or has reduced activities (compared to the unmodified antibody) in any one or more of the following: triggering complement mediated lysis, stimulating antibody-dependent cell mediated cytotoxicity (ADCC), or activating microglia. Different modifications of the constant region may be used to achieve optimal level and/or combination of effector functions. See, for example, Morgan et al., Immunology 86:319-324, 1995; Lund et al., J. Immunology 157:4963-9 157:4963-4969, 1996; Idusogie et al., J. Immunology 164:4178-4184, 2000; Tao et al., J. Immunology 143: 2595-2601, 1989; and Jefferis et al., Immunological Reviews 163:59-76, 1998. In some embodiments, the constant region is modified as described in Eur. J. Immunol., 29:2613-2624, 1999; PCT Application No. PCT/GB99/01441, and/or UK Application No. 9809951.8. In still other embodiments, the constant region is aglycosylated for N-linked glycosylation. In some embodiments, the constant region is aglycosylated for N-linked glycosylation by mutating the glycosylated amino acid residue or flanking residues that are part of the N-glycosylation recognition sequence in the constant region. For example, N-glycosylation site N297 may be mutated to A, Q, K, or H. See, Tao et al., J. Immunology 143: 2595-2601, 1989; and Jefferis et al., Immunological Reviews 163:59-76, 1998. In some embodiments, the constant region is aglycosylated for N-linked glycosylation. The constant region may be aglycosylated for N-linked glycosylation enzymatically (such as removing carbohydrate by enzyme PNGase), or by expression in a glycosylation deficient host cell.

Other antibody modifications include antibodies that have been modified as described in PCT Publication No. WO99/58572. These antibodies comprise, in addition to a binding domain directed at the target molecule, an effector domain having an amino acid sequence substantially homologous to all or part of a constant region of a human immunoglobulin heavy chain. These antibodies are capable of binding the target molecule without triggering significant complement dependent lysis, or cell-mediated destruction of the target. In some embodiments, the effector domain is capable of specifically binding FcRn and/or FcγRIIb. These are typically based on chimeric domains derived from two or more human immunoglobulin heavy chain CH2 domains. Antibodies modified in this manner are particularly suitable for use in chronic antibody therapy, to avoid inflammatory and other adverse reactions to conventional antibody therapy.

The invention includes affinity matured embodiments. For example, affinity matured antibodies can be produced by procedures known in the art (Marks et al., Bio/Technology, 10:779-783, 1992; Barbas et al., Proc Nat. Acad. Sci, USA 91:3809-3813, 1994; Schier et al., Gene, 169:147-155, 1995; Yelton et al., J. Immunol., 155:1994-2004, 1995; Jackson et al., J. Immunol., 154(7):3310-9, 1995, Hawkins et al., J. Mol. Biol., 226:889-896, 1992; and PCT Publication No. WO04/058184).

The following methods may be used for adjusting the affinity of an antibody and for characterizing a CDR. One way of characterizing a CDR of an antibody and/or altering (such as improving) the binding affinity of a polypeptide, such as an antibody, termed "library scanning mutagenesis". Generally, library scanning mutagenesis works as follows. One or more amino acid positions in the CDR are replaced with two or more (such as 3, 4, 5, 6, 7, 8, 9, 10, 11, 12, 13, 14, 15, 16, 17, 18, 19, or 20) amino acids using art recognized methods. This generates small libraries of clones (in some embodiments, one for every amino acid position that is analyzed), each with a complexity of two or more members (if two or more amino acids are substituted at every position). Generally, the library also includes a clone comprising the native (unsubstituted) amino acid. A small number of clones, e.g., about 20-80 clones (depending on the complexity of the library), from each library are screened for binding affinity to the target polypeptide (or other binding target), and candidates with increased, the same, decreased, or no binding are identified. Methods for determining binding affinity are well-known in the art. Binding affinity may be determined using BIACORE™ surface plasmon resonance analysis, which detects differences in binding affinity of about 2-fold or greater. BIACORE™ is particularly useful when the starting antibody already binds with a relatively high affinity, for example a $K_D$ of about 10 nM or lower. Screening using BIACORE™ surface plasmon resonance is described in the Examples, herein.

Binding affinity may be determined using Kinexa Biocensor, scintillation proximity assays, ELISA, ORIGEN immunoassay (IGEN), fluorescence quenching, fluorescence transfer, and/or yeast display. Binding affinity may also be screened using a suitable bioassay.

In some embodiments, every amino acid position in a CDR is replaced (in some embodiments, one at a time) with all 20 natural amino acids using art recognized mutagenesis methods (some of which are described herein). This generates small libraries of clones (in some embodiments, one for every amino acid position that is analyzed), each with a complexity of 20 members (if all 20 amino acids are substituted at every position).

In some embodiments, the library to be screened comprises substitutions in two or more positions, which may be in the same CDR or in two or more CDRs. Thus, the library may comprise substitutions in two or more positions in one CDR. The library may comprise substitution in two or more positions in two or more CDRs. The library may comprise substitution in 3, 4, 5, or more positions, said positions found in two, three, four, five or six CDRs. The substitution may be prepared using low redundancy codons. See, e.g., Table 2 of Balint et al., Gene 137(1):109-18, 1993.

Candidates with improved binding may be sequenced, thereby identifying a CDR substitution mutant which results in improved affinity (also termed an "improved" substitution). Candidates that bind may also be sequenced, thereby identifying a CDR substitution which retains binding.

Multiple rounds of screening may be conducted. For example, candidates (each comprising an amino acid substitution at one or more position of one or more CDR) with improved binding are also useful for the design of a second library containing at least the original and substituted amino acid at each improved CDR position (i.e., amino acid position in the CDR at which a substitution mutant showed improved binding). Preparation, and screening or selection of this library is discussed further below.

Library scanning mutagenesis also provides a means for characterizing a CDR, in so far as the frequency of clones with improved binding, the same binding, decreased binding or no binding also provide information relating to the importance of each amino acid position for the stability of the antibody-antigen complex. For example, if a position of the CDR retains binding when changed to all 20 amino acids, that position is identified as a position that is unlikely to be required for antigen binding. Conversely, if a position of CDR retains binding in only a small percentage of substitutions, that position is identified as a position that is important to CDR function. Thus, the library scanning mutagenesis methods generate information regarding positions in the CDRs that can be changed to many different amino acids (including all 20 amino acids), and positions in the CDRs which cannot be changed or which can only be changed to a few amino acids.

Candidates with improved affinity may be combined in a second library, which includes the improved amino acid, the original amino acid at that position, and may further include additional substitutions at that position, depending on the complexity of the library that is desired, or permitted using the desired screening or selection method. In addition, if desired, adjacent amino acid position can be randomized to at least two or more amino acids. Randomization of adjacent amino acids may permit additional conformational flexibility in the mutant CDR, which may in turn, permit or facilitate the introduction of a larger number of improving mutations. The library may also comprise substitution at positions that did not show improved affinity in the first round of screening.

The second library is screened or selected for library members with improved and/or altered binding affinity using any method known in the art, including screening using BIACORE™ surface plasmon resonance analysis, and selection using any method known in the art for selection, including phage display, yeast display, and ribosome display.

This invention also provides compositions comprising antibodies conjugated (for example, linked) to an agent that facilitate coupling to a solid support (such as biotin or avidin). For simplicity, reference will be made generally to antibodies with the understanding that these methods apply to any of the GUCY2c antibody embodiments described herein. Conjugation generally refers to linking these components as described herein. The linking (which is generally fixing these components in proximate association at least for administration) can be achieved in any number of ways. For example, a direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

In certain embodiments, as a first step, the first and second polypeptide (and any additional polypeptides forming the bispecific antibody) is selected. Normally, the nucleic acid encoding these polypeptides needs to be isolated so that it can be altered to encode the knob or hole, or both, as herein defined. However, the mutations can be introduced using synthetic means, e.g., by using a peptide synthesizer. Also, in the case where the substituted residue is a non-naturally occurring residue, the method of Noren et al., supra is available for making polypeptides having such substitutions. Additionally, part of the bispecific antibody is suitably made recombinantly in cell culture and other part(s) of the molecule are made by those techniques mentioned above.

Techniques for isolating antibodies and preparing bispecific antibodies follow. However, it will be appreciated that the bispecific antibodies can be formed from, or incorporate, other polypeptides using techniques which are known in the art. For example, nucleic acid encoding a polypeptide of interest (e.g., a ligand, receptor or enzyme) can be isolated from a cDNA library prepared from tissue believed to possess the polypeptide mRNA and to express it at a detectable level. Libraries are screened with probes (such as antibodies or oligonucleotides of about 20-80 bases) designed to identify the gene of interest or the protein encoded by it. Screening the cDNA or genomic library with the selected probe may be conducted using standard procedures as described in chapters 10-12 of Sambrook et al., Molecular Cloning: A Laboratory Manual (New York: Cold Spring Harbor Laboratory Press, 1989).

As stated previously, bispecific antibody refers to a complex of two or more polypeptide chains, each comprising at least one antibody VL region and one antibody VH region or fragment thereof, wherein the VL and VH regions in each polypeptide chain are from different antibodies. In specific aspects, bispecific antibody includes dimers or tetramers of polypeptide chains containing both a VL and VH region. The individual polypeptide chains comprising the multimeric proteins may be covalently joined to at least one other peptide of the multimer by interchain disulfide bonds.

The bispecific antibodies of the present invention simultaneously target T cells (CD3) and tumor cells (GUCY2c) and successfully direct and activate T cell cytoxicity to tumor cells expressing GUCY2c.

Each polypeptide chain of the bispecific antibody comprises a VL region and a VH region, which may be covalently linked by a linker wherein the linker is a glycine-serine linker comprising glycine and serine residues such that the antibody binding domains are constrained from self-assembly. In a particular embodiment, the glycine-serine linker is Linker 1 comprising a sequence of SEQ ID NO: 190. In addition, each polypeptide chain comprises a heterodimerization domain, which promotes heterodimerization and/or stabilization of the multiple polypeptide chains and reduces the probability of homodimerization of the different polypeptide chains. The heterodimerization domain may be located at the N-terminal of the polypeptide chain or the C-terminal. The heterodimerization domain may comprise a cysteine linker (Linker 2) that is 1, 2, 3, 4, 5, 6, or more amino acid residues in length. Interaction of two of the polypeptide chains may produce two VL/VH pairings, forming two epitope binding domains, i.e., a bivalent molecule. Neither the VH or VL region is constrained to any position within the polypeptide chain, i.e., restricted to the amino terminal or the carboxy terminal, nor are the regions restricted in their relative positions to one another, i.e., the VL region may be N-terminal to the VH region and vice versa. The only restriction is that a complimentary polypeptide chain be available in order to form a functional bispecific antibody. Where the VL and VH regions are derived from antibodies specific for different antigens, formation of a functional bispecific antibody requires the interaction of two different polypeptide chains, i.e., formation of a heterodimer. In contrast, where two differing polypeptide chains are free to interact, e.g., in a recombinant expression system, one comprising a VLA and a VHB (A, being a first epitope and B, being a second epitope) and the other comprising a VLB and a VHA, two differing binding sites may form: VLA-VHA and VLB-VHB. For all bispecific antibody polypeptide chain pairs, misalignment or mis-binding of the two chains is a possibility, e.g., interaction of VL-VL or VH-VH regions. However, purification of functional bispecific antibodies is easily managed based on the immunospecificity of the properly dimerized binding site using any affinity based method known in the art or exemplified herein, e.g., affinity chromatography.

In one embodiment, the polypeptide chains of the bispecific antibody may comprise various linkers and peptides. The linkers and peptides may be 0, 1, 2, 3, 4, 5, 6, 7, 8, 9 or more amino acids. In some embodiments, the GUCY2c VL and the CD3 VH are linked by Linker 1 or Linker 2; and the CD3 VL and the GUCY2c VH are linked by Linker 1 or Linker 2. In some such embodiments, Linker 1 comprises a sequence of SEQ ID NO: 190. In other embodiments, Linker 2 comprises a sequence of SEQ ID NO: 191.

In some embodiments, Domain 1 is covalently bound to the first heterodimer-promoting domain via a cysteine linker and Domain 2 is covalently bound to the second heterodimer-promoting domain via a cysteine linker. The cysteine linkers each include at least one cysteine residue to permit intramolecular disulfide bonding. In further embodiments of each of the foregoing, the cysteine linker comprises at least five amino acids. In some such embodiments, the cysteine linker is Linker 3 comprising a sequence of SEQ ID NO: 192.

In some embodiments, the first polypeptide chain is covalently bound to the second polypeptide chain by at least one disulfide bond. In some such embodiments, at least one disulfide bond forms between Linker 3 of the first polypeptide chain and Linker 3 of the second polypeptide chain. In another such embodiment, at least one disulfide bond is formed between the first heterodimer-promoting domain and the second heterodimer-promoting domain. In specific embodiments, each disulfide bond is formed by linking two cysteine residues.

The bispecific antibodies of the invention may simultaneously bind two separate and distinct epitopes. In certain embodiments, at least one epitope binding site is specific for the CD3 determinant expressed on an immune effector cell e.g., expressed on T lymphocytes. In one embodiment, the bispecific antibody molecule binds to the effector cell determinant and also activates the effector cell.

In particular embodiments, the bispecific antibody of the present invention (a) binds to the extracellular domain of human GUCY2c, (b) demonstrates an extended serum and tumor half-life of between 30 min to 100 days; and/or (c) demonstrates a lower $EC_{50}$ value of between 0.0001 nM and 100 nM in the presence of increased GUCY2c expression levels or increased receptor density levels.

In one embodiment, the epitope-binding domain is capable of binding the GUCY2c tumor-associated antigen that is associated with breast, ovarian, thyroid, prostate, cervical, lung (including but not limited to non-small cell lung cancer and small cell lung cancer), bladder, endometrial, head and neck, testicular, and glioblastoma cancer. In certain embodiments, the cancer is the cancer of digestive system selected from the group consisting of esophagus, stomach, small intestine, colon, rectum, anus, liver, gall bladder, appendix, bile ducts, and pancreas. In specific embodiments, the therapy activates a cytolytic T cell response.

The bispecific antibodies of the present invention comprise antigen binding domains generally derived from immunoglobulins or antibodies. The antibodies from which the binding domains used in the methods of the invention are derived may be from any animal origin including birds and mammals (e.g., human, non-human primate, murine, donkey, sheep, rabbit, goat, guinea pig, camel, horse, or chicken). Preferably, the antibodies are human or humanized monoclonal antibodies.

The bispecific antibodies of the present invention may be characterized in a variety of ways. In particular, molecules of the invention may be assayed for the ability to immunospecifically bind to an antigen. Molecules that have been identified to immunospecifically bind to an antigen can then be assayed for their specificity and affinity for the antigen.

The bispecific antibody of the present invention may be produced using a variety of methods well known in the art, including de novo protein synthesis and recombinant expression of nucleic acids encoding the binding proteins. The desired nucleic acid sequences may be produced by recombinant methods (e.g., PCR mutagenesis of an earlier prepared variant of the desired polynucleotide) or by solid-phase DNA synthesis. Usually recombinant expression methods are used. In one aspect, the invention provides a polynucleotide that comprises a sequence encoding a CD3 VH and/or VL; in another aspect, the invention provides a polynucleotide that comprises a sequence encoding a GUCY2c VH and/or VL. Because of the degeneracy of the genetic code, a variety of nucleic acid sequences encode each immunoglobulin amino acid sequence, and the present invention includes all nucleic acids encoding the binding proteins described herein.

The bispecific antibody of the present invention may comprise two scFv domains that bind a target antigen and CD3, which is fused to an Fc domain of IgG. In one embodiment of the invention, the bispecific antibody comprises two scFv domains that bind GUCY2c and CD3 epsilon, which is fused to an Fc domain of IgG1. In particular, FIGS. 1A, 1B, 1C and 1D show four alternative representations of CD3-GUCY2c bispecific antibodies. The bispecific antibody comprises a first heterodimer-promoting and a second heterodimer-promoting domain. Each first heterodimer-promoting and second heterodimer-promoting domain may comprise a CH2 domain and/or a CH3 domain of an immunoglobulin Fc region, wherein the CH2 domain and/or CH3 domain have been altered to comprise a knob (protuberance) or a hole (cavity). Modifications to the Fc portion of the bispecific antibody are described below.

In an aspect of the present invention, a bispecific antibody, as shown in FIGS. 1A, 1B, 1C and 1D, comprises a first polypeptide chain and a second polypeptide chain.

In one aspect, the invention provides a bispecific antibody as further described herein, wherein: (a) the first polypeptide chain comprises, in the N-terminal to C-terminal direction: (i) a Domain 1, comprising a VL of a GUCY2c antibody (GUCY2c VL), and a VH of a CD3 antibody (CD3 VH), and (ii) a first heterodimer-promoting domain; and (b) the second polypeptide chain comprises, in the N-terminal to C-terminal direction: (i) a Domain 2, comprising a VL of a CD3 antibody (CD3 VL), and a VH of a GUCY2c antibody (GUCY2c VH), and (ii) a second heterodimer-promoting domain.

In another aspect, the invention provides a bispecific antibody as described herein, wherein: (a) the first polypeptide chain comprises, in the N-terminal to C-terminal direction: (i) a Domain 1, comprising a CD3 VL, and a GUCY2c VH, and (ii) a first heterodimer-promoting domain; and (b) the second polypeptide chain comprises, in the N-terminal to C-terminal direction: (i) a Domain 2 comprising a GUCY2c VL, and a CD3 VH, and (ii) a second heterodimer-promoting domain.

In yet another aspect, the invention provides a bispecific antibody as described herein, wherein: (a) the first polypeptide chain comprises, in the N-terminal to C-terminal direction: (i) a Domain 1, comprising a GUCY2c VH, and a CD3 VL, and (ii) a first heterodimer-promoting domain; and (b) the second polypeptide chain comprises, in the N-terminal to C-terminal direction: (i) a Domain 2, comprising a CD3 VH, and a GUCY2c VL, and (ii) a second heterodimer-promoting domain.

In another aspect, the invention provides a bispecific antibody as described herein, wherein: wherein: (a) the first polypeptide chain comprises, in the N-terminal to C-terminal direction: (i) a Domain 1, comprising a CD3 VH, and a GUCY2c VL, and (ii) a first heterodimer-promoting domain; and (b) the second polypeptide chain comprises, in the N-terminal to C-terminal direction: (i) a Domain 2, comprising a GUCY2c VH, and a CD3 VL, and (ii) a second heterodimer-promoting domain.

In some embodiments of the foregoing, the GUCY2c VL and the GUCY2c VH form a domain that specifically binds to GUCY2c; and the CD3 VL and the CD3 VH form a domain that specifically binds to CD3.

In further embodiments of any of the foregoing, the bispecific antibody of the present invention comprises (a) a GUCY2c VH CDR1 comprising a sequence of SEQ ID NO: 12, 20, 27, 34, 42, 74, 257, 258, 259, 260, or 261; (b) a GUCY2c VH CDR2 comprising a sequence of SEQ ID NO: 13, 21, 28, 35, 43, 53, 66, 68, 70, 72, 75, 262, 263, 264, 265, 266, or 267; (c) a GUCY2c VH CDR3 comprising a sequence of SEQ ID NO: 14, 22, 29, 36, or 44; (d) a GUCY2c VL CDR1 comprising a sequence of SEQ ID NO: 93, 101, 105, 107, 113, 120, 148, 153, 163, or 167; (e) a GUCY2c VL CDR2 comprising a sequence of SEQ ID NO:

78, 94, 102, 108, 114, 141, 144, 146, 149, 151, 157, 159, 161, 164, or 168; and (f) a GUCY2c VL CDR3 comprising a sequence of SEQ ID NO: 95, 109, 115, 121, 142, 154, 165, or 169.

In a particular embodiment, the bispecific antibody of the present invention comprises (a) a GUCY2c VH CDR1 comprising a sequence of SEQ ID NO: 74; (b) a GUCY2c VH CDR2 comprising a sequence of SEQ ID NO: 75; (c) a GUCY2c VH CDR3 comprising a sequence of SEQ ID NO: 29; (d) a GUCY2c VL CDR1 comprising a sequence of SEQ ID NO: 148; (e) a GUCY2c VL CDR2 comprising the sequence of SEQ ID NO: 149; and (f) a GUCY2c VL CDR3 comprising a sequence of SEQ ID NO: 142.

In specific embodiments, the bispecific antibody comprises: (a) a GUCY2c VH region comprising a sequence of SEQ ID NO: 73; and (b) a GUCY2c VL region comprising the sequence shown in SEQ ID NO: 147.

In additional embodiments, the invention provides bispecific antibodies comprising (a) a CD3 VH CDR1 comprising a sequence of SEQ ID NO: 2; (b) a CD3 VH CDR2 comprising a sequence of SEQ ID NO: 3 or 10; (c) a CD3 VH CDR3 comprising a sequence of SEQ ID NO: 4; (d) a CD3 VL CDR1 comprising a sequence of SEQ ID NO: 77, 85, or 91; (e) a CD3 VL CDR2 comprising the SEQ ID NO: 78; and (f) a CD3 VL CDR3 comprising a sequence of SEQ ID NO: 79.

In a particular embodiment, the invention provides a bispecific antibody comprising (a) a CD3 VH CDR1 comprising the sequence of SEQ ID NO: 2; (b) a CD3 VH CDR2 comprising the sequence of SEQ ID NO: 10; (c) a CD3 VH CDR3 comprising the sequence of SEQ ID NO: 4; (d) a CD3 VL CDR1 comprising the sequence of SEQ ID NO: 91; (e) a CD3 VL CDR2 comprising the sequence of SEQ ID NO: 78; and (f) a CD3 VL CDR3 comprising the sequence of SEQ ID NO: 79.

In one embodiment, the invention provides a bispecific antibody comprising: (a) a CD3 VH region comprising the sequence of SEQ ID NO: 1, 9, or 273; and (b) a CD3 VL region comprising the sequence of SEQ ID NO: 76, 84, 90, 274, 275, or 276. In a particular embodiment, the bispecific antibody of the present invention comprises: (a) a CD3 VH region comprising the sequence of SEQ ID NO: 9; and (b) a CD3 VL region comprising the sequence of SEQ ID NO: 90.

In another aspect of the invention, Linker 3 may comprise a truncated human IgG1 lower hinge region having the sequence GCPPCP (SEQ ID NO: 192) with at least one glycine residue preceding the lower hinge region.

In one aspect, the first heterodimer-promoting domain may comprise an Fc chain having a CH2 and/or CH3 domain altered to comprise either a knob Fc chain (protuberance) comprising the sequence of SEQ ID NO: 188, 196, 199, 202, 205, 210, 216, or 248, 282, 284, or 286; or a hole Fc chain (cavity) comprising a sequence of SEQ ID NO: 189, 197, 200, 203, 206, 211, 217, 220, 249, 283, 285, or 287. In another aspect, the second heterodimer-promoting domain may comprise an Fc chain having a CH2 and/or CH3 domain altered to comprise either a knob Fc chain (protuberance) comprising a sequence of SEQ ID NO: 188, 196, 199, 202, 205, 210, 216, or 248, 282, 284, or 286, if such first heterodimer region comprises a hole Fc chain (cavity), or a hole Fc chain (cavity) comprising a sequence of SEQ ID NO: 189, 197, 200, 203, 206, 211, 217, 220, 249, 283, 285, or 287, if such first heterodimer region comprises a knob Fc chain (protuberance) (Table 7).

Table 9 provides the nucleic acid sequences for the first polypeptide chain and second polypeptide chain of the bispecific antibodies with the various GUCY2c and CD3 antibodies described herein. SEQ ID NOs: 246 and 247 provide the corresponding nucleotide sequences as used herein.

TABLE 9

| | |
|---|---|
| GUCY2C-1608 first polypeptide chain (SEQ ID NO: 246) | gacatccagctgacccagtctccatcctccctgtctgcatctgtaggagacagagtc accatcacttgcagagccagtgaaagtgttgattattatggcagtagtttattgcagtg gtatcagcagaaaccagggaaagcccctaagctcctgatctatgctgcatccaaa ctagcttctggggtcccatcaaggttcagtggcagtggatctgggacagatttcactc tcaccatcagcagtctgcaacctgaagattttgcaacttactactgtcagcaaactcg gaaagcgtatacgtttggccaggggaccaagctggagatcaaaggtggaggtag cggggcggcggggaagttcaactcgttgagtctggcgggggattggttcaaccc ggtggaagccttagattgtcatgtgccgcctccggctttacatttagcgactattacat gacctgggtgagacaagctccaggcaaaggacttgaatgggtggcctttatcaga aatcaggcccgcggctacacaagcgaccataatccctccgtgaaggaagattta ccatcagccgggacaatgctaaaaattcactttaccttcaaatgaactctcttagagc cgaggacaccgccgtatactactgcgcaagagatagaccaagttattacgtcctgg attactggggccagggaacaaccgtcaccgtgtcttctggatgcccaccgtgccca gcacctgaagccgctggggcaccgtcagtcttcctcttcccccaaaacccaagg acacctcatgatctcccgaccctgaggtcacatgcgtggtggtggacgtgagc cacgaagaccctgaggtcaagttcaactggtacgtggacggcgtggaggtgcata atgccaagacaaagccgcgggaggagcagtacaacagcacgtaccgtgtggtc agcgtcctcaccgtcctgcaccaggactggctgaatggcaaggagtacaagtgca aggtctccaacaaagccctcccagcccccatcgagaaaaccatctccaaagcca aagggcagccccgagaaccacaggtgtgcaccctgcccccatcccggaggag atgaccaagaaccaggtcagcctgtggtgcctggtcaaaggcttctatcccagcga catcgccgtggagtgggagagcaatgggcagccggagaacaactacaagacc acgcctcccgtgctggactccgacggctccttcttcctctatagcaagctcaccgtgg acaagagcaggtggcagcaggggaacgtcttctcatgctccgtgatgcatgaggc tctgcacaaccactacacgcagaagagcctctccctgtccccggaaag |
| GUCY2C-1608 second polypeptide chain (SEQ ID NO: 247) | gacatccagatgacccagtcccctcttctctgtctgcctctgtgggcgacagagtga ccatcacctgcacaagctcacgtcactgtttaatgtccgcagccagaaaaactat cttgcgtggtatcagcagaagcctggcaaggctcccaagctgctgatctactgggc cagtacacgagaatccggcgtgccttccagattctccggctctggctctggcaccga tttcaccctgaccatctcctccctccagcctgaggattcgccacctactactgcaaac agtcttacgaccttttcacttttggcggcggaacaaaggtggagatcaagggcgga ggtggatctggcggcggaggcgaggtgcagctggtggagtctgggggaggcttg gtccagcctgggggtccctgagactctcctgtgcagcctctggcttcaccttcagca gctactggatgcactgggtccgccaggctccagggaaggggctggagtggattgg |

TABLE 9-continued

```
agagattaaacctagcaacgaacttactaacgtccatgaaaagttcaaggaccga
ttcaccatctccgtggacaaggccaagaactcagcctatctgcaaatgaacagcct
gagagccgaggacacggctgtgtattactgtacaagaacgattacgacgacgga
gggatactggttcttcgatgtctggggccaagggacactggtcaccgtctcttcagg
atgtccaccgtgcccagcacctgaagccgctggggcaccgtcagtcttcctcttccc
cccaaaacccaaggacaccctcatgatctcccggaccctgaggtcacatgcgtg
gtggtggacgtgagccacgaagaccctgaggtcaagttcaactggtacgtggacg
gcgtggaggtgcataatgccaagacaaagccgcgggaggagcagtacaacag
cacgtaccgtgtggtcagcgtcctcaccgtcctgcaccaggactggctgaatggca
aggagtacaagtgcaaggtctccaacaaagccctcccagcccccatcgagaaa
accatctccaaagccaaagggcagccccgagaaccacaggtgtacaccctgcc
cccatgcccgggaggagatgaccaagaaccaggtcagcctgtcctgcgcggtcaa
aggcttctatcccagcgacatcgccgtggagtgggagagcaatgggcagccgga
gaacaactacaagaccacgcctcccgtgctggactccgacggctccttcttcctcgt
tagcaagctcaccgtggacaagagcaggtggcagcaggggaacgtcttctcatg
ctccgtgatgcatgaggctctgcacaaccactacacgcagaagagcctctccctgt
cccccggaaag
```

Effector Null Mutations in Human IgG1 CH2-CH3

The Fc chain of human IgG1 was modified to introduce mutations L234A, L235A and G237A (SEQ ID NO: 187, numbering according to the EU index) using standard primer-directed PCR mutagenesis to oblate effector function due to binding to FcγRIII providing for an effector function null phenotype (Canfield et al., J. Exp. Med (1991) 173: 1483-1491; Shields et al., J. Biol. Chem. (2001) 276:6591-604).

Knobs-in-Holes Mutations in Human IgG1 CH2-CH3

Knobs-in-holes is an effective design strategy known in the art for engineering antibody heavy chain homodimers for heterodimerization. In this approach a 'knob' variant was obtained by replacement of a small amino acid with a larger one in one chain of the Fc chain of IgG1, e.g., Y349C and T366W, (numbering according to the EU index). The 'knob' was designed to insert into a 'hole' in the CH3 domain of the complimentary chain of the Fc chain created by replacement of a large residue with a smaller one e.g., S354C, T366S, L368A and Y407V, (numbering according to the EU index).

In some embodiment, complimentary mutations were introduced to derive heterodimerization of the resultant Fc chains, such that each Fc chain would carry one set of mutations, Y349C and T366W for the knob (or protuberance) Fc chain (SEQ ID NO: 188), or S354C, T366S, L368A and Y407V for the hole (or cavity) Fc chain (SEQ ID NO: 189), as provided in Table 10. When co-transfected into a suitable mammalian host the DNA encoding the amino acid sequences for example of SEQ ID NOs: 246 and 247 produce an Fc domain that is predominantly bispecific antibody possessing one knob (or protuberance) Fc chain associated with one hole (or cavity) Fc chain.

The CD3-GUCY2c bispecific antibodies of the present invention are stable against aggregation in thermal stability studies and, potent bispecific antibody-Fc fusions targeting both human CD3 and GUCY2c. The knob-in-hole Fc domain allows for improved expression in CHO cells and improved purification resulting in high purity of desired heterodimer. The mutations engineered within the Fc domain abrogate FcγR binding thus potentially avoiding ADCC mediated T cell depletion. Further, the incorporation of the Fc domain to a bispecific antibody enhances stability of the molecule as shown by differential scanning calorimetry (DSC).

The bispecific antibody may be engineered to comprise at least one cysteine residue that may interact with a counterpart cysteine residue on another polypeptide chain of the invention to form an inter-chain disulfide bond. The inter-chain disulfide bonds may serve to stabilize the bispecific antibody, improving expression and recovery in recombinant systems, resulting in a stable and consistent formulation, as well as, improving the stability of the isolated and/or purified product in vivo. The cysteine residue or residues may be introduced as a single amino acid or as part of larger amino-acid sequence, e.g., hinge region, in any portion of the polypeptide chain. In a specific aspect, at least one cysteine residue is engineered to occur at the C-terminus of the polypeptide chain.

In one aspect, the invention provides a bispecific antibody that specifically binds to GUCY2c and competes for binding with the bispecific antibody as disclosed herein. In some such embodiments, the bispecific antibody specifically binds to an epitope of GUCY2c.

In one aspect, the invention provides a bispecific antibody that specifically binds to GUCY2c and CD3, wherein the bispecific antibody comprises a first polypeptide chain and

TABLE 10

| | |
|---|---|
| Knob Fc chain Mutations (SEQ ID NO: 188) | APEAAGAPSVFLFPPKPKDTLMISRTPEVTCWVDVSHEDPEVKF NWYVDGVEVHNAKTKPREEQYNSTYRVVSVLTVLHQDWLNGKE YKCKVSNKALPAPIEKTISKAKGQPREPQVCTLPPSREEMTKNQV SLWCLVKGFYPSDIAVEWESNGQPENNYKTTPPVLDSDGSFFLY SKLTVDKSRWQQGNVFSCSVMHEALHNHYTQKSLSLSPG |
| Hole Fc chain Mutations (SEQ ID NO: 189) | APEAAGAPSVFLFPPKPKDTLMISRTPEVTCWVDVSHEDPEVKF NWYVDGVEVHNAKTKPREEQYNSTYRVVSVLTVLHQDWLNGKE YKCKVSNKALPAPIEKTISKAKGQPREPQVYTLPPCREEMTKNQV SLSCAVKGFYPSDIAVEWESNGQPENNYKTTPPVLDSDGSFFLV SKLTVDKSRWQQGNVFSCSVMHEALHNHYTQKSLSLSPG | a second polypeptide chain, and wherein: (a) the first polypeptide chain comprises the following regions in the following order in an N-terminal to C-terminal direction: a VL of an anti-GUCY2c antibody (GUCY2c VL) (SEQ ID NO: 147)—Linker 1 (SEQ ID NO: 190)—a VH of an anti-CD3 antibody (CD3 VH) (SEQ ID NO: 9)—Linker 3 (SEQ ID NO: 192)—a first heterodimer-promoting domain (SEQ ID NO: 188); and (b) the second polypeptide chain comprises the following regions in the following order in an N-terminal to C-terminal direction: a VL of an anti-CD3 antibody (CD3 VL) (SEQ ID NO: 90)—Linker 2 (SEQ ID NO: 191)—a VH of an anti-GUCY2c antibody (GUCY2c VH) (SEQ ID NO: 73)—Linker 3 (SEQ ID NO: 192)—a second heterodimer-promoting domain (SEQ ID NO: 189).

In another aspect, the invention provides a bispecific antibody that specifically binds to GUCY2c and CD3, wherein the bispecific antibody comprises a first polypeptide chain and a second polypeptide chain, and wherein: (a) the first polypeptide chain comprises the following regions in the following order in an N-terminal to C-terminal direction: a VL of an anti-GUCY2c antibody (GUCY2c VL) (SEQ ID NO: 147)—Linker 1 (SEQ ID NO: 190)—a VH of an anti-CD3 antibody (CD3 VH) (SEQ ID NO: 9)—Linker 3 (SEQ ID NO: 192)—a first heterodimer-promoting domain (SEQ ID NO: 188); and (b) the second polypeptide chain comprises the following regions in the following order in an N-terminal to C-terminal direction: a VL of an anti-CD3 antibody (CD3 VL) (SEQ ID NO: 90)—Linker 2 (SEQ ID NO: 191)—a VH of an anti-GUCY2c antibody (GUCY2c VH) (SEQ ID NO: 73)—Linker 3 (SEQ ID NO: 192)—a second heterodimer-promoting domain (SEQ ID NO: 189); wherein the GUCY2c VL and the GUCY2c VH form a domain that specifically binds to GUCY2c; and the CD3 VL and the CD3 VH form a domain that specifically binds to CD3, wherein Linker 3 of the first polypeptide chain and Linker 3 of the second polypeptide chain are covalently bound to one another by two disulfide bonds; wherein the first heterodimer-promoting domain and the second heterodimer-promoting domain each comprise a CH2 domain and a CH3 domain; wherein the CH3 domain of the first heterodimer-promoting domain forms a knob, and the CH3 domain of the second heterodimer-promoting domain forms a hole; wherein at least one disulfide bond is formed between the CH3 domain of the first heterodimer-promoting domain and the CH3 domain of the second heterodimer-promoting domain.

In some such embodiments, the invention provides a bispecific antibody that specifically binds to an epitope of GUCY2c and an epitope of CD3.

In some embodiments, the invention provides a bispecific antibody further comprising a human or humanized VH framework, and a human or humanized VL framework. In some such embodiments, the bispecific antibody is a humanized antibody. In specific embodiments, the VH framework comprises a sequence of SEQ ID NO: 5, 6, 7, 8, 15, 16, 17, 18, 23, 24, 25, 30, 31, 32, 37, 38, 39, 40, 45, 46, 47, 49, 50, 51, 54, 55, 56, 58, 59, 61, or 63; and/or the VL framework comprises a sequence of SEQ ID NO: 80, 81, 82, 83, 86, 87, 88, 89, 96, 97, 98, 99, 103, 110, 111, 116, 117, 118, 122, 123, 124, 126, 127, 128, 130, 131, 132, 133, 135, 139, or 155.

In one aspect, the bispecific antibody of the present invention specifically binds to GUCY2c and CD3, wherein the bispecific antibody comprises a first polypeptide chain and a second polypeptide chain; wherein the first polypeptide chain is produced by the expression vector with ATCC Accession No. PTA-124944; and the second polypeptide chain is produced by the expression vector with ATCC Accession No. PTA-124943.

In one aspect, the invention provides a bispecific antibody capable of specific binding to GUCY2c and to CD3 comprising a first polypeptide chain and a second polypeptide chain, wherein the first polypeptide chain comprises a sequence of SEQ ID NO: 216 and the second polypeptide chain comprises a sequence of SEQ ID NO: 220.

In some such embodiments, the invention provides a bispecific antibody, wherein the first and second polypeptide chains are covalently bonded to one another by at least one disulfide bond.

The present invention further provides a pharmaceutical composition comprising a therapeutically effective amount of an antibody or a bispecific antibody disclosed herein, and a pharmaceutically acceptable carrier.

The invention encompasses methods and compositions for treatment, prevention or management of cancer in a subject, comprising administering to the subject a therapeutically effective amount of an antibody or a bispecific antibodies engineered in accordance with the invention, which molecule further binds a cancer antigen. Molecules of the invention may be particularly useful for the prevention, inhibition, reduction of growth and/or regression of primary tumors and metastasis of cancer cells. Although not intending to be bound by a particular mechanism of action, molecules of the invention may mediate effector function which may result in tumor clearance, tumor reduction or a combination thereof.

The antibodies (e.g., GUCY2c or CD3-GUCY2c bispecific) of the present invention are useful in various applications including, but are not limited to, therapeutic treatment methods and diagnostic treatment methods.

In one aspect, the invention provides a method for treating a condition associated with GUCY2c expression in a subject. In some embodiments, the method of treating a condition associated with GUCY2c expression in a subject comprises administering to the subject in need thereof an effective amount of a composition (e.g., pharmaceutical composition) comprising the GUCY2c antibodies or the GUCY2c bispecific antibodies, as described herein. The conditions associated with GUCY2c expression include, but are not limited to, abnormal GUCY2c expression, altered or aberrant GUCY2c expression, malignant cells expressing GUCY2c, and a proliferative disorder (e.g., cancer).

Accordingly, the invention provides methods of treating cancer characterized by a GUCY2c antigen by engineering the bispecific antibody to immunospecifically recognize the GUCY2c antigen and a CD3 antigen on T cells. The bispecific antibodies that have been engineered according to the invention are useful for prevention or treatment of cancer, since they have a cytotoxic activity by anti CD3 induced activated killer T cells.

In a particular embodiment, the present invention provides a method of treating a GUCY2c associated disorder in a patient in need thereof, comprising administering to the patient a GUCY2c antibody as disclosed herein. The present invention also provides a method of treating a GUCY2c associated disorder in a patient in need thereof, comprising administering to the patient a bispecific antibody of the present invention.

The present invention further provides a method of treating a GUCY2c associated disorder in a patient in need thereof, comprising administering to the patient a pharmaceutical composition comprising a GUCY2c antibody or a bispecific antibody disclosed herein. In some such embodiments, the GUCY2c associated disorder is cancer. In specific embodiments, the cancer is breast, ovarian, thyroid, prostate, cervical, lung (including but not limited to non-small cell lung cancer and small cell lunch cancer), bladder, endometrial, head and neck, testicular, or glioblastoma cancer. In certain embodiments, the cancer is the cancer of digestive system selected from the group consisting of esophagus, stomach, small intestine, colon, rectum, anus, liver, gall bladder, appendix, bile ducts, and pancreas. In specific embodiments, the therapy activates a cytolytic T cell response.

In one aspect, the present invention provides an antibody, a bispecific antibody, or a pharmaceutical composition as disclosed herein for use in therapy. In a particular embodiment, the invention also provides a GUCY2c antibody or CD3-GUCY2c bispecific antibody for use in the method of treating cancer defined herein.

The present invention further provides an antibody, or a bispecific antibody as disclosed herein for use in the manufacture of a medicament for use in therapy. In some embodiments, the therapy is a treatment of a GUCY2c associated disorder. In specific embodiments, the GUCY2c associated disorder is cancer. In some embodiments, the cancer is selected from the group consisting of breast, ovarian, thyroid, prostate, cervical, lung (including but not limited to non-small cell lung cancer and small cell lunch cancer), bladder, endometrial, head and neck, testicular, and glioblastoma cancer. In certain embodiments, the cancer is the cancer of digestive system selected from the group consisting of esophagus, stomach, small intestine, colon, rectum, anus, liver, gall bladder, appendix, bile ducts, and pancreas. In specific embodiments, the therapy activates a cytolytic T cell response.

In one aspect, the present invention provides a polynucleotide that encodes an antibody or a bispecific antibody as disclosed herein. In another embodiment, the invention provides a vector comprising polynucleotides as disclosed herein. In yet another embodiment, the invention provides a host cell transformed or transfected with the vectors as disclosed herein. In some such embodiments, the host cell recombinantly produces the antibody or the bispecific antibody as disclosed herein. In specific embodiments, the host cell is selected from the group consisting of bacterial so cell lines, mammalian cell lines, insect cell lines and yeast cell lines. In a particular embodiment, the mammalian cell line is a CHO cell line. In one embodiment, the antibody or the bispecific antibody is produced using an in vitro cell free protein synthesis system.

In one aspect, provided is a method of treating a cancer in a subject in need thereof comprising a) providing the bispecific antibody as described herein, and b) administering said bispecific antibody to said patient. In some embodiments, provided is a method of treating a condition associated with malignant cells expressing a tumor antigen in a subject comprising a) providing the antibody as described herein, and b) administering to the subject in need thereof an effective amount of a pharmaceutical composition comprising an antibody as described herein. Examples of the cancer to be treated include, but are not limited to, esophagus cancer, stomach cancer, small intestine cancer, colon cancer, rectum cancer, anus cancer, liver cancer, gall bladder cancer, appendix cancer, bile ducts cancer, and pancreas cancer. Accordingly, the compositions and methods described herein can be used to treat, image, detect and vaccinate against above-listed primary and metastatic cancers.

In some embodiments, provided is a method of inhibiting tumor growth or progression in a subject who has malignant cells expressing GUCY2c, comprising administering to the subject in need thereof an effective amount of a composition comprising the GUCY2c antibodies or CD3-GUCY2c bispecific antibodies, as described herein. In other embodiments, provided is a method of inhibiting metastasis cells expressing GUCY2c in a subject, comprising administering to the subject in need thereof an effective amount of a composition comprising the GUCY2c antibodies or CD3-GUCY2c bispecific antibodies, as described herein. In other embodiments, provided is a method of inducing tumor regression in malignant cells in a subject, comprising administering to the subject in need thereof an effective amount of a composition comprising the GUCY2c antibodies or CD3-GUCY2c bispecific antibodies, as described herein.

In a specific aspect, GUCY2c antibodies or CD3-GUCY2c bispecific antibody of the invention inhibit or reduce the growth of cancer cells by at least 99%, at least 95%, at least 90%, at least 85%, at least 80%, at least 75%, at least 70%, at least 60%, at least 50%, at least 45%, at least 40%, at least 45%, at least 35%, at least 30%, at least 25%, at least 20%, or at least 10% relative to the growth of cancer cells in the absence of the antibody or a bispecific antibody of the invention.

In a specific aspect, GUCY2c antibodies or CD3-GUCY2c bispecific antibodies kill cells or inhibits or reduces the growth of cancer cells at least 5%, at least 10%, at least 20%, at least 25%, at least 30%, at least 35%, at least 40%, at least 45%, at least 50%, at least 60%, at least 70%, at least 75%, at least 80%, at least 85%, at least 90%, at least 95%, or at least 100% better than in the absence of the antibody or a bispecific antibodies of the invention.

In one embodiment, provided is a method of treating an autoimmune disorder in a subject comprising administering to the subject in need thereof an effective amount of a composition comprising the GUCY2c antibodies or CD3-GUCY2c bispecific antibodies, as described herein.

As used herein, autoimmune disorders include, but are not limited to, inflammatory bowel disease, systemic lupus erythematosus, diabetes (Type I), celiac disease, agammaglobulinemia, autoimmune enteropathy, autoimmune hepatitis, Crohn's disease, gastrointestinal pemphigoid, polymyositis, transverse myelitis, ulcerative colitis, and vasculitis.

In one aspect, the invention provides an effective amount of a composition (e.g., pharmaceutical composition) comprising the antibodies (e.g., GUCY2c antibodies or CD3-GUCY2c bispecific antibodies), as described herein for treating a condition (e.g., cancer) associated with GUCY2c expression in a subject in need thereof. In one embodiment, provided is an effective amount of a composition (e.g., pharmaceutical composition) comprising the antibodies (e.g., GUCY2c antibodies or CD3-GUCY2c bispecific antibodies), as described herein for inhibiting tumor growth or progression in a subject who has malignant cells expressing GUCY2c. In some embodiments, provided is an effective amount of a composition (e.g., pharmaceutical composition) comprising the antibodies (e.g., GUCY2c antibodies or CD3-GUCY2c bispecific antibodies), as described herein for inhibiting metastasis of malignant cells expressing GUCY2c in a subject in need thereof. In some embodiments, provided is an effective amount of a composition (e.g., pharmaceutical composition) comprising the antibodies (e.g., GUCY2c antibodies or CD3-GUCY2c bispecific antibodies), as described herein.

In another aspect, the invention provides the antibodies (e.g., GUCY2c antibodies or CD3-GUCY2c), as described herein for use in treating a condition (e.g., cancer) associated with GUCY2c expression in a subject in need thereof. In some embodiments, provided is the antibodies (e.g., GUCY2c antibodies or CD3-GUCY2c bispecific antibodies), as described herein for inhibiting tumor growth or progression in a subject who has malignant cells expressing GUCY2c. In some embodiments, provided is the antibodies (e.g., GUCY2c antibodies or CD3-GUCY2c bispecific antibodies) as described herein for inhibiting metastasis of malignant cells expressing GUCY2c in a subject in need thereof. In some embodiments, provided is the antibodies (e.g., GUCY2c antibodies or CD3-GUCY2c bispecific antibodies), as described herein for inducing tumor regression in a subject who has malignant cells expressing GUCY2c.

In another aspect, the invention provides a use of the antibodies (e.g., GUCY2c antibodies or CD3-GUCY2c bispecific antibodies), as described herein in the manufacture of a medicament for treating a condition (e.g., cancer) associated with GUCY2c expression. In some embodiments, provided is a use of the antibodies (e.g., GUCY2c antibodies or CD3-GUCY2c bispecific antibodies), as described herein in the manufacture of a medicament for inhibiting tumor growth or progression. In some embodiments, provided is a use of the antibodies (e.g., GUCY2c antibodies or CD3-GUCY2c bispecific antibodies), as described herein in the manufacture of a medicament for inhibiting metastasis of malignant cells expressing GUCY2c. In some embodiments, provided is a use of the antibodies (e.g., GUCY2c antibodies or CD3-GUCY2c bispecific antibodies), as described herein in the manufacture of a medicament for inducing tumor regression.

In another aspect, provided is a method of detecting, diagnosing, and/or monitoring a condition associated with GUCY2c expression. For example, the antibodies (e.g., GUCY2c antibodies or CD3-GUCY2c bispecific antibodies), as described herein can be labeled with a detectable moiety such as an imaging agent and an enzyme-substrate label. The antibodies as described herein can also be used for in vivo diagnostic assays, such as in vivo imaging (e.g., PET or SPECT), or a staining reagent.

Accordingly, in addition to redirecting T cells to tumor-specific antigens, the CD3-GUCY2c bispecific antibodies of the present invention can be used to carry other diagnostic or therapeutic agents to cells expressing a tumor on their surface. Thus, a bispecific antibody may be attached directly or indirectly, e.g., via a linker, to a drug so that it will be delivered directly to cells bearing a tumor. Therapeutic agents include, but are not limited to, nucleic acids, proteins, peptides, amino acids or derivatives, glycoproteins, radioisotopes, lipids, carbohydrates, or recombinant viruses. Nucleic acid diagnostic or therapeutic agents include, but are not limited to, antisense nucleic acids, derivatized oligonucleotides for covalent cross-linking with single or duplex DNA, and triplex forming oligonucleotides.

Alternatively, the diagnostic or therapeutic agents linked to the bispecific antibodies of the present invention may be an encapsulation system, such as a liposome or micelle that contains a therapeutic agent such as a drug, a nucleic acid (e.g. an antisense nucleic acid), or another therapeutic agent that is preferably shielded from direct exposure to the circulatory system. Means of preparing liposomes attached to antibodies are well known to those of skill in the art. See, for example, U.S. Pat. No. 4,957,735; and Connor, et al., Pharm. Ther. 28:341-365 (1985).

In some embodiments, the methods described herein further comprise a step of treating a subject with an additional form of therapy. In some embodiments, the additional form of therapy is an additional anti-cancer therapy including, but not limited to, chemotherapy, radiation, surgery, hormone therapy, and/or additional immunotherapy.

The invention further encompasses administering the molecules of the invention in combination with other therapies known to those skilled in the art for the treatment or prevention of cancer including but not limited to, current standard and experimental chemotherapies, biological therapies, immunotherapies, radiation therapies, or surgery. In some aspects, the molecules of the invention may be administered in combination with a therapeutically or prophylactically effective amount of one or more agents, therapeutic antibodies or other agents known to those skilled in the art for the treatment and/or prevention of cancer.

Accordingly, methods for treating cancer include administering to a subject in need thereof an effective amount of an antibody or bispecific antibody of the present invention in combination with a chemotherapeutic agent. Such combination treatment may be administered separately, sequentially, or simultaneously. Suitable chemotherapeutic agents include, but are not limited to, at least one additional agent such as bevacizumab, cetuximb, sirolimus, panitumumab, 5-fluorouracil (5-FU), capecitabine, tivozanib, irinotecan, oxaliplatin, cisplatin, trifluridine, tipiracil, leucovori, gemcitabine and/or erlotinib hydrochloride.

The dosage amounts and frequencies of administration provided herein are encompassed by the terms therapeutically effective and prophylactically effective. The dosage and frequency further may vary according to factors specific for each patient depending on the specific therapeutic or prophylactic agents administered, the severity and type of cancer, the route of administration, as well as age, body weight, response, and the past medical history of the patient. Suitable regimens may be selected by one skilled in the art by considering such factors and by following, for example, dosages reported in the literature and recommended in the Physician's Desk Reference ($56^{th}$ ed., 2002).

The antibodies or the bispecific antibodies of the present invention may be in the form of a pharmaceutical composition for administration that are formulated to be appropriate for the selected mode of administration, and pharmaceutically acceptable diluent or excipients, such as buffers, surfactants, preservatives, solubilizing agents, isotonicity agents, stabilizing agents, carriers, and the like. Remington's Pharmaceutical Sciences, Mack Publishing Co., Easton Pa., $18^{th}$ ed., 1995, provides a compendium of formulation techniques as are generally known to practitioners.

These pharmaceutical compositions may be administered by any means known in the art that achieve the generally intended purpose to treat cancer. The route of administration may be parenteral, defined herein as referring to modes of administration that include but not limited to transesophageal, intratumoral, transcolonoscopically, transcutaneously, intravenous, intramuscular, intraperitoneal, subcutaneous, and intraarticular injection and infusion. The manner of administration and dosing of the of the molecules according to the invention (e.g., GUCY2c antibodies, CD3-GUCY2c bispecific antibody, pharmaceutical composition) depend on the type of disease to be combated, where appropriate the stage thereof, the antigen to be controlled, the kind of concurrent treatment, if any, frequency of treatment, the nature of the effect desired, and also the body weight, the age, the health the diet and the sex of the patient. Thus, the dosage regimen actually employed can vary widely and therefore can deviate from the dosage regimens set forth herein.

Various formulations of the antibodies of the present invention (e.g., GUCY2c antibodies or CD3-GUCY2c bispecific antibodies) may be used for administration. In some embodiments, the antibodies (e.g., GUCY2c antibodies or CD3-GUCY2c bispecific antibody) may be administered neat. In some embodiments, the antibody (e.g., GUCY2c antibody or CD3-GUCY2c bispecific antibody) and a pharmaceutically acceptable excipient may be in various formulations. Pharmaceutically acceptable excipients are known in the art, and are relatively inert substances that facilitate administration of a pharmacologically effective substance. For example, an excipient can give form or consistency, or act as a diluent. Suitable excipients include but are not limited to stabilizing agents, wetting and emulsifying agents, salts for varying osmolarity, encapsulating agents, buffers, and skin penetration enhancers. Excipients as well as formulations for parenteral and nonparenteral drug delivery are set forth in Remington, The Science and Practice of Pharmacy 21st Ed. Mack Publishing, 2005.

In some embodiments, these agents are formulated for administration by injection (e.g., intraperitoneally, intravenously, subcutaneously, intramuscularly, etc.). Accordingly, these agents can be combined with pharmaceutically acceptable vehicles such as saline, Ringer's solution, dextrose solution, and the like. The particular dosage regimen, i.e., dose, timing and repetition, will depend on the particular individual and that individual's medical history.

The antibodies (e.g., GUCY2c antibodies or CD3-GUCY2c bispecific antibodies) as described herein can be administered using any suitable method, including by injection (e.g., intraperitoneally, intravenously, subcutaneously, intramuscularly, etc.). The antibody, e.g., monoclonal antibody or bispecific antibody, also be administered via inhalation, as described herein. Generally, for administration of the antibody of the present invention (e.g., GUCY2c antibody or CD3-GUCY2c bispecific antibody), the dosage depends upon the host treated and the particular mode of administration. In one embodiment, the dose range of the antibody of the present invention will be about 0.001 µg/kg body weight to about 20,000 µg/kg body weight. The term "body weight" is applicable when a patient is being treated. When isolated cells are being treated, "body weight" as used herein refers to a "total cell body weight". The term "total body weight" may be used to apply to both isolated cell and patient treatment. All concentrations and treatment levels are expressed as "body weight" or simply "kg" in this application are also considered to cover the analogous "total cell body weight" and "total body weight" concentrations. However, those of ordinary skill in the art will recognize the utility of a variety of dosage range, for example, 0.01 µg/kg body weight to 20,000 µg/kg body weight, 0.02 µg/kg body weight to 15,000 µg/kg body weight, 0.03 µg/kg body weight to 10,000 µg/kg body weight, 0.04 µg/kg body weight to 5,000 µg/kg body weight, 0.05 µg/kg body weight to 2,500 µg/kg body weight, 0.06 µg/kg body weight to 1,000 µg/kg body weight, 0.07 µg/kg body weight to 500 µg/kg body weight, 0.08 µg/kg body weight to 400 µg/kg body weight, 0.09 µg/kg body weight to 200 µg/kg body weight or 0.1 µg/kg body weight to 100 µg/kg body weight. Further, those of skill will recognize that a variety of different dosage levels will be of use, for example, 0.0001 µg/kg, 0.0002 µg/kg, 0.0003 µg/kg, 0.0004 µg/kg, 0.005 µg/kg, 0.0007 µg/kg, 0.001 µg/kg, 0.1 µg/kg, 1.0 µg/kg, 1.5 µg/kg, 2.0 µg/kg, 5.0 µg/kg, 10.0 µg/kg, 15.0 µg/kg, 30.0 µg/kg, 50 µg/kg, 75 µg/kg, 80 µg/kg, 90 µg/kg, 100 µg/kg, 120 µg/kg, 140 µg/kg, 150 µg/kg, 160 µg/kg, 180 µg/kg, 200 µg/kg, 225 µg/kg, 250 µg/kg, 275 µg/kg, 300 µg/kg, 325 µg/kg, 350 µg/kg, 375 µg/kg, 400 µg/kg, 450 µg/kg, 500 µg/kg, 550 µg/kg, 600 µg/kg, 700 µg/kg, 750 µg/kg, 800 µg/kg, 900 µg/kg, 1 µg/kg, 5 µg/kg, 10 µg/kg, 12 µg/kg, 15 mg/kg, 20 mg/kg, and/or 30 mg/kg. All of these dosages are exemplary, and any dosage in-between these points is also expected to be of use in the invention. Any of the above dosage ranges or dosage levels may be employed for an antibody of the present invention. For repeated administrations over several days or longer, depending on the condition, the treatment is sustained until a desired suppression of symptoms occurs or until sufficient therapeutic levels are achieved, for example, to inhibit or delay tumor growth/progression or metastasis of cancer cells.

Other dosage regimens may also be useful, depending on the pattern of pharmacokinetic decay that the practitioner wishes to achieve. In one embodiment, the antibody of the present invention is administered in an initial priming dose followed by a higher and/or continuous, substantially constant dosage. In some embodiments, dosing from one to four times a week is contemplated. In other embodiments, dosing once a month or once every other month or every three months is contemplated. The progress of this therapy is easily monitored by conventional techniques and assays. The dosing regimen (including the antibody (e.g., GUCY2c antibody or CD3-GUCY2c bispecific antibody) can vary over time.

For the purpose of the present invention, the appropriate dosage of an antibody (e.g., GUCY2c antibody or CD3-GUCY2c bispecific antibody) will depend on the antibody (e.g., GUCY2c antibody or CD3-GUCY2c bispecific antibody) or compositions thereof employed, the type and severity of symptoms to be treated, whether the agent is administered for therapeutic purposes, previous therapy, the patient's clinical history and response to the agent, the patient's clearance rate for the administered agent, and the discretion of the attending physician. Typically the clinician will administer an antibody (e.g., GUCY2c antibody or CD3-GUCY2c bispecific antibody) until a dosage is reached that achieves the desired result. Dose and/or frequency can vary over course of treatment. Empirical considerations, such as the half-life, generally will contribute to the determination of the dosage. For example, antibodies that are compatible with the human immune system, such as humanized antibodies or fully human antibodies, may be used to prolong half-life of the antibody and to prevent the antibody being attacked by the host's immune system. Frequency of administration may be determined and adjusted over the course of therapy, and is generally, but not necessarily, based on treatment and/or suppression and/or amelioration and/or delay of symptoms, e.g., tumor growth inhibition or delay, etc. Alternatively, sustained continuous release formulations of antibodies (e.g., GUCY2c antibodies or CD3-GUCY2c bispecific antibody) may be appropriate. Various formulations and devices for achieving sustained release are known in the art.

In one embodiment, dosages for an antibody (e.g., GUCY2c antibody or CD3-GUCY2c bispecific antibody) may be determined empirically in individuals who have been given one or more administration(s) of the antibody (e.g., GUCY2c antibody or CD3-GUCY2c bispecific antibody). Individuals are given incremental dosages of an antibody (e.g., GUCY2c antibody or CD3-GUCY2c bispecific antibody). To assess efficacy, an indicator of the disease can be followed.

In certain embodiments, the administration of an antibody (e.g., GUCY2c antibody or CD3-GUCY2c bispecific antibody) leads to at least one effect selected from the group consisting of inhibition of tumor growth, tumor regression, reduction in the size of a tumor, reduction in tumor cell number, delay in tumor growth, abscopal effect, inhibition of tumor metastasis, reduction in metastatic lesions over time, reduced use of chemotherapeutic or cytotoxic agents, reduction in tumor burden, increase in progression-free survival, increase in overall survival, complete response, partial response, and stable disease.

Administration of an antibody (e.g., GUCY2c antibody or CD3-GUCY2c bispecific antibody) in accordance with the method in the present invention can be continuous or intermittent, depending, for example, upon the recipient's physiological condition, whether the purpose of the administration is therapeutic or prophylactic, and other factors known to skilled practitioners. The administration of an antibody (e.g., GUCY2c antibody or CD3-GUCY2c bispecific antibody) may be essentially continuous over a preselected period of time or may be in a series of spaced doses.

In some embodiments, more than one antibody (e.g., GUCY2c antibody or CD3-GUCY2c bispecific antibody) may be present. At least one, at least two, at least three, at least four, at least five different or more antibodies (e.g., GUCY2c antibodies or CD3-GUCY2c bispecific antibodies) can be present. Generally, those (e.g., GUCY2c antibodies or CD3-GUCY2c bispecific antibodies) may have complementary activities that do not adversely affect each other. For example, one or more of the following antibody may be used: a first GUCY2c or CD3 antibody directed to one epitope on GUCY2c or CD3 and a second GUCY2c or CD3 antibody directed to a different epitope on GUCY2c or CD3.

Therapeutic formulations of the antibody (e.g., GUCY2c antibody or CD3-GUCY2c bispecific antibody) used in accordance with the present invention are prepared for storage by mixing an antibody having the desired degree of purity with optional pharmaceutically acceptable carriers, excipients or stabilizers (Remington, The Science and Practice of Pharmacy 21st Ed. Mack Publishing, 2005), in the form of lyophilized formulations or aqueous solutions. Acceptable carriers, excipients, or stabilizers are nontoxic to recipients at the dosages and concentrations employed, and may comprise buffers such as phosphate, citrate, and other organic acids; salts such as sodium chloride; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens, such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

Liposomes containing the antibody (e.g., GUCY2c antibody or CD3-GUCY2c bispecific antibody) are prepared by methods known in the art, such as described in Epstein, et al., Proc. Natl. Acad. Sci. USA 82:3688, 1985; Hwang, et al., Proc. Natl Acad. Sci. USA 77:4030, 1980; and U.S. Pat. Nos. 4,485,045 and 4,544,545. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter.

The active ingredients may also be entrapped in microcapsules prepared, for example, by coacervation techniques or by interfacial polymerization, for example, hydroxymethylcellulose or gelatin-microcapsules and poly-(methylmethacrylate) microcapsules, respectively, in colloidal drug delivery systems (for example, liposomes, albumin microspheres, microemulsions, nano-particles and nanocapsules) or in macroemulsions. Such techniques are disclosed in Remington, The Science and Practice of Pharmacy 21st Ed. Mack Publishing, 2005.

Sustained-release preparations may be prepared. Suitable examples of sustained-release preparations include semipermeable matrices of solid hydrophobic polymers containing the antibody, which matrices are in the form of shaped articles, e.g., films, or microcapsules. Examples of sustained-release matrices include polyesters, hydrogels (for example, poly(2-hydroxyethyl-methacrylate), or 'poly(vinylalcohol)), polylactides (U.S. Pat. No. 3,773,919), copolymers of L-glutamic acid and 7 ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), sucrose acetate isobutyrate, and poly-D-(−)-3-hydroxybutyric acid.

The formulations to be used for in vivo administration must be sterile. This is readily accomplished by, for example, filtration through sterile filtration membranes. Therapeutic antibody (e.g., GUCY2c antibody or CD3-GUCY2c bispecific antibody) compositions are generally placed into a container having a sterile access port, for example, an intravenous solution bag or vial having a stopper pierceable by a hypodermic injection needle.

The compositions according to the present invention may be in unit dosage forms such as tablets, pills, capsules, powders, granules, solutions or suspensions, or suppositories, for oral, parenteral or rectal administration, or administration by inhalation or insufflation.

For preparing solid compositions such as tablets, the principal active ingredient is mixed with a pharmaceutical carrier, e.g., conventional tableting ingredients such as corn starch, lactose, sucrose, sorbitol, talc, stearic acid, magnesium stearate, dicalcium phosphate or gums, and other pharmaceutical diluents, e.g., water, to form a solid preformulation composition containing a homogeneous mixture of a compound of the present invention, or a non-toxic pharmaceutically acceptable salt thereof. When referring to these preformulation compositions as homogeneous, it is meant that the active ingredient is dispersed evenly throughout the composition so that the composition may be readily subdivided into equally effective unit dosage forms such as tablets, pills and capsules. This solid preformulation composition is then subdivided into unit dosage forms of the type described above containing from 0.1 to about 500 mg of the active ingredient of the present invention. The tablets or pills of the novel composition can be coated or otherwise compounded to provide a dosage form affording the advantage of prolonged action. For example, the tablet or pill can comprise an inner dosage and an outer dosage component, the latter being in the form of an envelope over the former. The two components can be separated by an enteric layer that serves to resist disintegration in the stomach and permits the inner component to pass intact into the duodenum or to be delayed in release. A variety of materials can be used for such enteric layers or coatings, such materials including a number of polymeric acids and mixtures of polymeric acids with such materials as shellac, cetyl alcohol and cellulose acetate.

Suitable surface-active agents include, in particular, nonionic agents, such as polyoxyethylenesorbitans (e.g., Tween™ 20, 40, 60, 80 or 85) and other sorbitans (e.g., Span™ 20, 40, 60, 80 or 85). Compositions with a surface-active agent will conveniently comprise between 0.05 and 5% surface-active agent, and can be between 0.1 and 2.5%. It will be appreciated that other ingredients may be added, for example mannitol or other pharmaceutically acceptable vehicles, if necessary.

Suitable emulsions may be prepared using commercially available fat emulsions, such as Intralipid™, Liposyn™, Infonutrol™, Lipofundin™ and Lipiphysan™. The active ingredient may be either dissolved in a pre-mixed emulsion composition or alternatively it may be dissolved in an oil (e.g., soybean oil, safflower oil, cottonseed oil, sesame oil, corn oil or almond oil) and an emulsion formed upon mixing with a phospholipid (e.g., egg phospholipids, soybean phospholipids or soybean lecithin) and water. It will be appreciated that other ingredients may be added, for example glycerol or glucose, to adjust the tonicity of the emulsion. Suitable emulsions will typically contain up to 20% oil, for example, between 5 and 20%. The fat emulsion can comprise fat droplets between 0.1 and 1.0 µm, particularly 0.1 and 0.5 µm, and have a pH in the range of 5.5 to 8.0.

The emulsion compositions can be those prepared by mixing an antibody (e.g., GUCY2c antibody or CD3-GUCY2c bispecific antibody) with Intralipid™ or the components thereof (soybean oil, egg phospholipids, glycerol and water).

Compositions for inhalation or insufflation include solutions and suspensions in pharmaceutically acceptable, aqueous or organic solvents, or mixtures thereof, and powders. The liquid or solid compositions may contain suitable pharmaceutically acceptable excipients as set out above. In some embodiments, the compositions are administered by the oral or nasal respiratory route for local or systemic effect. Compositions in preferably sterile pharmaceutically acceptable solvents may be nebulized by use of gases. Nebulized solutions may be breathed directly from the nebulizing device or the nebulizing device may be attached to a face mask, tent or intermittent positive pressure breathing machine. Solution, suspension or powder compositions may be administered, preferably orally or nasally, from devices which deliver the formulation in an appropriate manner.

Compositions within the scope of the invention include all compositions wherein an antibody (GUCY2c antibody or CD3-GUCY2c bispecific antibody) is present in an amount that is effective to achieve the desired medical effect for treating cancer. While individual needs may vary from one patient to another, the determination of the optimal ranges of effective amounts of all of the components is within the ability of the clinician of ordinary skill.

Examples of such compositions, as well as how to formulate, are also described in an earlier section and below. In some embodiments, the composition comprises one or more antibodies (e.g., GUCY2c antibody or CD3-GUCY2c bispecific antibody). In some embodiments, the GUCY2c antibody or CD3-GUCY2c bispecific antibody is a human antibody, a humanized antibody, or a chimeric antibody. In some embodiments, the GUCY2c antibody or CD3-GUCY2c bispecific antibody comprises a constant region that is capable of triggering a desired immune response, such as antibody-mediated lysis or ADCC. In other embodiments, the GUCY2c antibody or CD3-GUCY2c bispecific antibody comprises a constant region that does not trigger an unwanted or undesirable immune response, such as antibody-mediated lysis or ADCC.

It is understood that the compositions can comprise more than one antibody (e.g., GUCY2c antibody or CD3-GUCY2c bispecific antibody), such as a mixture of GUCY2c antibodies or CD3-GUCY2c bispecific antibodies that recognize different epitopes of GUCY2c or CD3 and GUCY2c). Other exemplary compositions comprise more than one GUCY2c antibody or CD3-GUCY2c bispecific antibody, that recognize the same epitope(s), or different species of GUCY2c antibodies, CD3-GUCY2c bispecific antibodies, or that bind to different epitopes of GUCY2c (e.g., human GUCY2cA) or CD3 and GUCY2c (human CD3 and GUCY2c).

In some embodiments, the GUCY2c antibody or CD3-GUCY2c bispecific antibody may be administered in combination with the administration of one or more additional therapeutic agents. These include, but are not limited to, the administration of a biotherapeutic agent and/or a chemotherapeutic agent, such as but not limited to, a vaccine, a CAR-T cell-based therapy, radiotherapy, a cytokine therapy, a CD3 bispecific antibody, an inhibitor of other immunosuppressive pathways, an inhibitor of angiogenesis, a T cell activator, an inhibitor of a metabolic pathway, an mTOR inhibitor, an inhibitor of an adenosine pathway, a tyrosine kinase inhibitor including but not limited to Inlyta, ALK inhibitors and sunitinib, a BRAF inhibitor, an epigenetic modifier, an IDO1 inhibitor, a JAK inhibitor, a STAT inhibitor, a cyclin-dependent kinase inhibitor, a biotherapeutic agent (including but not limited to antibodies to VEGF, VEGFR, EGFR, Her2/neu, other growth factor receptors, CD40, CD-40L, CTLA-4, OX-40, 4-1BB, TIGIT, and ICOS), an immunogenic agent (for example, attenuated cancerous cells, tumor antigens, antigen presenting cells such as dendritic cells pulsed with tumor derived antigen or nucleic acids, immune stimulating cytokines (for example, IL-2, IFNα2, GM-CSF), and cells transfected with genes encoding immune stimulating cytokines such as but not limited to GM-CSF).

Examples of biotherapeutic agents include therapeutic antibodies, immune modulating agents, and therapeutic immune cells.

Therapeutic antibodies may have specificity against a variety of different of antigens. For example, therapeutic antibodies may be directed to a tumor associated-antigen, such that binding of the antibody to the antigen promotes death of the cell expressing the antigen. In other example, therapeutic antibodies may be directed to an antigen (e.g. PD-1) on an immune cell, such that binding of the antibody prevents downregulation of the activity of the cell expressing the antigen (and thereby promotes activity of the cell expressing the antigen). In some situations, a therapeutic antibody may function through multiple different mechanisms (for example, it may both i) promote death of the cell expressing the antigen, and ii) prevent the antigen from causing down-regulation of the activity of immune cells in contact with the cell expressing the antigen).

Therapeutic antibodies may be directed to, for example, the antigens listed as follows. For some antigens, exemplary antibodies directed to the antigen are also included below (in brackets/parenthesis after the antigen). The antigens as follow may also be referred to as "target antigens" or the like herein. Target antigens for therapeutic antibodies herein include, for example: 4-1BB (e.g. utomilumab); 5T4; A33; alpha-folate receptor 1 (e.g. mirvetuximab soravtansine); Alk-1, BCMA [e.g. PF-06863135 (see U.S. Pat. No. 9,969, 809)]; BTN1A1 (e.g. see WO2018222689); CA-125 (e.g. abagovomab); Carboanhydrase IX; CCR2; CCR4 (e.g. mogamulizumab); CCR5 (e.g. leronlimab); CCR8; CD3 [e.g. blinatumomab (CD3/CD19 bispecific), PF-06671008 (CD3/P-cadherin bispecific), PF-06863135 (CD3/BCMA bispecific), CD19 (e.g. blinatumomab, MOR208), CD20 (e.g. ibritumomab tiuxetan, obinutuzumab, ofatumumab, rituximab, ublituximab); CD22 (inotuzumab ozogamicin, moxetumomab pasudotox); CD25, CD28, CD30 (e.g. brentuximab vedotin); CD33 (e.g. gemtuzumab ozogamicin); CD38 (e.g. daratumumab, isatuximab), CD40, CD-40L; CD44v6; CD47, CD52 (e.g. alemtuzumab); CD63, CD79 (e.g. polatuzumab vedotin); CD80, CD123, CD276/B7-H3 (e.g. omburtamab); CDH17, CEA; ClhCG, CTLA-4 (e.g. ipilimumab, tremelimumab), CXCR4; desmoglein 4; DLL3 (e.g. rovalpituzumab tesirine); DLL4; E-cadherin; EDA; EDB; EFNA4; EGFR (e.g. cetuximab, depatuxizumab mafodotin, necitumumab, panitumumab); EGFRvIII, Endosialin; EpCAM (e.g. oportuzumab monatox); FAP; Fetal Acetylcholine Receptor; FLT3 (e.g. see WO2018/220584); GD2 (e.g. dinutuximab, 3F8); GD3; GITR; GloboH; GM1; GM2; GUCY2C (e.g. PF-07062119); HER2/neu [e.g. margetuximab, pertuzumab, trastuzumab; ado-trastuzumab emtansine, trastuzumab duocarmazine, PF-06804103 (see U.S. Pat. No. 8,828,401)]; HER3; HER4; ICOS; IL-10, ITG-AvB6; LAG-3 (e.g. relatlimab); Lewis-Y; LG; Ly-6; M-CSF [e.g. PD-0360324 (see US7326414)]; MCSP; mesothelin; MUC1; MUC2; MUC3; MUC4; MUC5AC; MUC513, MUC7; MUC16, Notch1; Notch3; Nectin-4 (e.g. enfortumab vedotin); OX40 [e.g. PF-04518600 (see US7960515)]; P-Cadherein [e.g. PF-06671008 (see WO2016/001810)]; PCDHB2; PD-1 [e.g. BCD-100, camrelizumab, cemiplimab, genolimzumab (CBT-501), MEDI0680, nivolumab, pembrolizumab, RN888 (see WO2016/092419), sintilimab, spartalizumab, STI-A1110, tislelizumab, TSR-042]; PD-L1 (e.g. atezolizumab, durvalumab, BMS-936559 (MDX-1105), or LY3300054); PDGFRA (e.g. olaratumab); Plasma Cell Antigen; PolySA; PSCA; PSMA; PTK7 [e.g. PF-06647020 (see US9409995)]; Ror1; SAS; SCRx6; SLAMF7 (e.g. elotuzumab); SHH; SIRPa (e.g. ED9, Effi-DEM); STEAP; TGF-beta; TIGIT; TIM-3; TMPRSS3; TNF-alpha precursor; TROP-2 (e.g sacituzumab govitecan); TSPAN8; VEGF (e.g. bevacizumab, brolucizumab); VEGFR1 (e.g. ranibizumab); VEGFR2 (e.g. ramucirumab, ranibizumab); Wue-1.

Therapeutic antibodies may have any suitable format. For example, therapeutic antibodies may have any format as described elsewhere herein. In some embodiments, a therapeutic antibody may be a naked antibody. In some embodiments, a therapeutic antibody may be linked to a drug/agent (also known as an "antibody-drug conjugate" (ADC)). In some embodiments, a therapeutic antibody against a particular antigen may incorporated into a multi-specific antibody (e.g. a bispecifc antibody).

In some embodiments, an antibody directed to an antigen may be conjugated to a drug/agent. Linked antibody-drug molecules are also referred to as "antibody-drug conjugates" (ADCs). Drugs/agents can be linked to an antibody either directly or indirectly via a linker. Most commonly, toxic drugs are linked to an antibody, such that binding of the ADC to the respective antigen promotes the killing of cells that express the antigen. For example, ADCs that are linked to toxic drugs are particularly useful for targeting tumor associated antigens, in order to promote the killing of tumor cells that express the tumor associated antigens. In other embodiments, agents that may be linked to an antibody may be, for example, an immunomodulating agent (e.g. to modulate the activity of immune cells in the vicinity of the ADC), an imaging agent (e.g. to facilitate the imaging of the ADC in a subject or a biological sample from the subject), or an agent to increase the antibody serum half-life or bioactivity.

Methods for conjugating cytotoxic agent or other therapeutic agents to antibodies have been described in various publications. For example, chemical modification can be made in the antibodies either through lysine side chain amines or through cysteine sulfhydryl groups activated by reducing interchain disulfide bonds for the conjugation reaction to occur. See, e.g., Tanaka et al., FEBS Letters 579:2092-2096, 2005, and Gentle et al., Bioconjugate Chem. 15:658-663, 2004. Reactive cysteine residues engineered at specific sites of antibodies for specific drug conjugation with defined stoichiometry have also been described. See, e.g., Junutula et al., Nature Biotechnology, 26:925-932, 2008. Conjugation using an acyl donor glutamine-containing tag or an endogenous glutamine made reactive (i.e., the ability to form a covalent bond as an acyl donor) by polypeptide engineering in the presence of transglutaminase and an amine (e.g., a cytotoxic agent comprising or attached to a reactive amine) is also described in international applications WO2012/059882 and WO2015015448. In some embodiments, an ADC may have any of the features or characteristics of the ADCs provided in WO2016166629, which is hereby incorporated by reference for all purposes.

Drugs/agents that can be linked to an antibody in the ADC format can include, for example, cytotoxic agents, immunomodulating agents, imaging agents, therapeutic proteins, biopolymers, or oligonucleotides.

Exemplary cytotoxic agents that may be incorporated in an ADC include an anthracycline, an auristatin, a dolastatin, a combretastatin, a duocarmycin, a pyrrolobenzodiazepine dimer, an indolino-benzodiazepine dimer, an enediyne, a geldanamycin, a maytansine, a puromycin, a taxane, a vinca alkaloid, a camptothecin, a tubulysin, a hemiasterlin, a spliceostatin, a pladienolide, and stereoisomers, isosteres, analogs, or derivatives thereof.

Exemplary immunomodulating agents that may be incorporated in an ADC include gancyclovier, etanercept, tacrolimus, sirolimus, voclosporin, cyclosporine, rapamycin, cyclophosphamide, azathioprine, mycophenolgate mofetil, methotrextrate, glucocorticoid and its analogs, cytokines, stem cell growth factors, lymphotoxins, tumor necrosis factor (TNF), hematopoietic factors, interleukins (e.g., interleukin-1 (IL-1), IL-2, IL-3, IL-6, IL-10, IL-12, IL-18, and IL-21), colony stimulating factors (e.g., granulocyte-colony stimulating factor (G-CSF) and granulocyte macrophage-colony stimulating factor (GM-CSF)), interferons (e.g., interferons-.alpha., -.beta. and -.gamma.), the stem cell growth factor designated "S 1 factor," erythropoietin and thrombopoietin, or a combination thereof.

Exemplary imaging agents that may be included in an ADC include fluorescein, rhodamine, lanthanide phosphors, and their derivatives thereof, or a radioisotope bound to a chelator. Examples of fluorophores include, but are not limited to, fluorescein isothiocyanate (FITC) (e.g., 5-FITC), fluorescein amidite (FAM) (e.g., 5-FAM), eosin, carboxyfluorescein, erythrosine, Alexa Fluor™. (e.g., Alexa 350, 405, 430, 488, 500, 514, 532, 546, 555, 568, 594, 610, 633, 647, 660, 680, 700, or 750), carboxytetramethylrhodamine (TAMRA) (e.g., 5,-TAMRA), tetramethylrhodamine (TMR), and sulforhodamine (SR) (e.g., SR101). Examples of chelators include, but are not limited to, 1,4,7,10-tetraazacyclododecane-N,N',N'',N'''-tetraacetic acid (DOTA), 1,4,7-triazacyclononane-1,4,7-triacetic acid (NOTA), 1,4,7-triazacyclononane, 1-glutaric acid-4,7-acetic acid (deferoxamine), diethylenetriaminepentaacetic acid (DTPA), and 1,2-bis(o-aminophenoxy)ethane-N,N,N',N'''-tetraacetic acid) (BAPTA).

Exemplary therapeutic proteins that may be included in an ADC include a toxin, a hormone, an enzyme, and a growth factor.

Exemplary biocompatible polymers that may be incorporated in an ADC include water-soluble polymers, such as polyethylene glycol (PEG) or its derivatives thereof and zwitterion-containing biocompatible polymers (e.g., a phosphorylcholine containing polymer).

Exemplary biocompatible polymers that may be incorporated in an ADC include anti-sense oligonucleotides.

In some embodiments, an antibody directed to an antigen provided herein may be incorporated into a bispecific antibody molecule. Bispecifc antibodies are monoclonal antibodies that have binding specificity for at least two different antigens.

Immune modulating agents include a variety of different molecule types which may stimulate an immune response in a subject, such as pattern recognition receptor (PRR) agonists, immunostimulatory cytokines, and cancer vaccines.

Pattern recognition receptors (PRRs) are receptors that are expressed by cells of the immune system and that recognize a variety of molecules associated with pathogens and/or cell damage or death. PRRs are involved in both the innate immune response and the adaptive immune immune response. PRR agonists may be used to stimulate the immune response in a subject. There are multiple classes of PRR molecules, including toll-like receptors (TLRs), RIG-I-like receptors (RLRs), nucleotide-binding oligomerization domain (NOD)-like receptors (NLRs), C-type lectin receptors (CLRs), and Stimulator of Interferon Genes (STING) protein.

The terms "TLR" and "toll-like receptor" refer to any toll-like receptor. Toll-like receptors are receptors involved in activating immune responses. TLRs recognize, for example, pathogen-associated molecular patterns (PAMPs) expressed in microbes, as well as endogenous damage-associated molecular patterns (DAMPs), which are released from dead or dying cells.

Molecules which activate TLRs (and thereby activate immune responses) are referred to herein as "TLR agonists". TLR agonists can include, for example, small molecules (e.g. organic molecule having a molecular weight under about 1000 Daltons), as well as large molecules (e.g. oligonucleotides and proteins). Some TLR agonists are specific for a single type of TLR (e.g. TLR3 or TLR9), while some TLR agonists activate two or more types of TLR (e.g. both TLR7 and TLR8).

Exemplary TLR agonists provided herein include agonists of TLR2, TLR3, TLR4, TLR5, TLR6, TLR7, TLR8, and TLR9.

Exemplary small molecule TLR agonists include those disclosed in, for example, U.S. Pat. Nos. 4,689,338; 4,929,624; 5,266,575; 5,268,376; 5,346,905; 5,352,784; 5,389,640; 5,446,153; 5,482,936; 5,756,747; 6,110,929; 6,194,425; 6,331,539; 6,376,669; 6,451,810; 6,525,064; 6,541,485; 6,545,016; 6,545,017; 6,573,273; 6,656,938; 6,660,735; 6,660,747; 6,664,260; 6,664,264; 6,664,265; 6,667,312; 6,670,372; 6,677,347; 6,677,348; 6,677,349; 6,683,088; 6,756,382; 6,797,718; 6,818,650; and 7,7091,214; U.S. Patent Publication Nos. 2004/0091491, 2004/0176367, and 2006/0100229; and International Publication Nos. WO 2005/18551, WO 2005/18556, WO 2005/20999, WO 2005/032484, WO 2005/048933, WO 2005/048945, WO 2005/051317, WO 2005/051324, WO 2005/066169, WO 2005/066170, WO 2005/066172, WO 2005/076783, WO 2005/079195, WO 2005/094531, WO 2005/123079, WO 2005/123080, WO 2006/009826, WO 2006/009832, WO 2006/026760, WO 2006/028451, WO 2006/028545, WO 2006/028962, WO 2006/029115, WO 2006/038923, WO 2006/065280, WO 2006/074003, WO 2006/083440, WO 2006/086449, WO 2006/091394, WO 2006/086633, WO 2006/086634, WO 2006/091567, WO 2006/091568, WO 2006/091647, WO 2006/093514, and WO 2006/098852.

Additional examples of small molecule TLR agonists include certain purine derivatives (such as those described in U.S. Pat. Nos. 6,376,501, and 6,028,076), certain imidazoquinoline amide derivatives (such as those described in U.S. Pat. No. 6,069,149), certain imidazopyridine derivatives (such as those described in U.S. Pat. No. 6,518,265), certain benzimidazole derivatives (such as those described in U.S. Pat. No. 6,387,938), certain derivatives of a 4-aminopyrimidine fused to a five membered nitrogen containing heterocyclic ring (such as adenine derivatives described in U.S. Pat. Nos. 6,376,501; 6,028,076 and 6,329,381; and in WO 02/08905), and certain 3-.beta.-D-ribofuranosylthiazolo[4,5-d]pyrimidine derivatives (such as those described in U.S. Publication No. 2003/0199461), and certain small molecule immuno-potentiator compounds such as those described, for example, in U.S. Patent Publication No. 2005/0136065.

Exemplary large molecule TLR agonists include as oligonucleotide sequences. Some TLR agonist oligonucleotide sequences contain cytosine-guanine dinucleotides (CpG) and are described, for example, in U.S. Pat. Nos. 6,194,388; 6,207,646; 6,239,116; 6,339,068; and 6,406,705. Some CpG-containing oligonucleotides can include synthetic immunomodulatory structural motifs such as those described, for example, in U.S. Pat. Nos. 6,426,334 and 6,476,000. Other TLR agonist nucleotide sequences lack CpG sequences and are described, for example, in International Patent Publication No. WO 00/75304. Still other TLR agonist nucleotide sequences include guanosine- and uridine-rich single-stranded RNA (ssRNA) such as those described, for example, in Heil et ah, Science, vol. 303, pp. 1526-1529, Mar. 5, 2004.

Other TLR agonists include biological molecules such as aminoalkyl glucosaminide phosphates (AGPs) and are described, for example, in U.S. Pat. Nos. 6,113,918; 6,303,347; 6,525,028; and 6,649,172.

TLR agonists also include inactivated pathogens or fractions thereof, which may activate multiple different types of TLR receptor. Exemplary pathogen-derived TLR agonists include BCG, *Mycobacterium obuense* extract, Talimogene laherparepvec (T-Vec) (derived from HSV-1), and Pexa-Vec (derived from vaccina virus).

In some embodiments, a TLR agonist may be an agonist antibody that binds specifically to the TLR.

Provided below are brief descriptions of various TLRs, as well as TLR agonists. The listing of a TLR agonist below for particular TLR should not be construed to indicate that a given TLR agonist necessarily only activates that TLR (e.g. certain molecules can activate multiple types of TLR, or even multiple classes of PRR). For example, some molecules provided below as an exemplary TLR4 agonist may also be a TLR5 agonist.

The terms "TLR1" and "toll-like receptor 1" refer to any form of the TLR1 receptor, as well as variants, isoforms, and species homologs that retain at least a part of the activity of TLR1. Unless indicated differently, such as by specific reference to human TLR1, TLR1 includes all mammaila species of native sequence TLR1, e.g. human, monkey, and mouse. One exemplary human TLR1 is provided under UniProt Entry No. Q15399.

"TLR1 agonist" as used herein means, any molecule, which upon binding to TLR1, (1) stimulates or activates TLR1, (2) enhances, increases, promotes, induces, or prolongs an activity, function, or presence of TLR1, or (3) enhances, increases, promotes, or induces the expression of TLR1. TLR1 agonists useful in the any of the treatment methods, medicaments and uses of the present invention include, for example, bacterial lipoproteins and derivatives thereof which bind TLR1.

Examples of TLR1 agonists that are useful in the treatment methods, medicaments, and uses of the present invention include, for example, bacterial lipoproteins and derivatives thereof such as SPM-105 (derived from autoclaved mycobacteria), OM-174 (lipid A derivative), OmpS1 (porin from *Salmonella typhi*), OmpS1 (porin from *Salmonella typhi*), OspA (from *Borrelia burgdorferi*), MALP-2 (mycoplasmal macrophage-activating lipopeptide-2kD), STF (soluble tuberculosis factor), CU-T12-9, Diprovocim, and lipopeptides derived from cell-wall components such as PAM2CSK4, PAM3CSK4, and PAM3Cys.

TLR1 can form a heterodimer with TLR2, and accordingly, many TLR1 agonists are also TLR2 agonists.

The terms "TLR2" and "toll-like receptor 2" refer to any form of the TLR2 receptor, as well as variants, isoforms, and species homologs that retain at least a part of the activity of TLR2. Unless indicated differently, such as by specific reference to human TLR2, TLR2 includes all mammaila species of native sequence TLR2, e.g. human, monkey, and mouse. One exemplary human TLR2 is provided under UniProt Entry No. O60603.

"TLR2 agonist" as used herein means, any molecule, which upon binding to TLR2, (1) stimulates or activates TLR2, (2) enhances, increases, promotes, induces, or prolongs an activity, function, or presence of TLR2, or (3) enhances, increases, promotes, or induces the expression of TLR2. TLR2 agonists useful in the any of the treatment methods, medicaments and uses of the present invention include, for example, bacterial lipoproteins and derivatives thereof which bind TLR2.

Examples of TLR2 agonists that are useful in the treatment methods, medicaments, and uses of the present invention include, for example, bacterial lipoproteins (e.g. diacylated lipoproteins) and derivatives thereof such as SPM-105 (derived from autoclaved mycobacteria), OM-174 (lipid A derivative), OmpS1 (porin from *Salmonella typhi*), OmpS1 (porin from *Salmonella typhi*), OspA (from *Borrelia burgdorferi*), MALP-2 (mycoplasmal macrophage-activating lipopeptide-2kD), STF (soluble tuberculosis factor), CU-T12-9, Diprovocim, Amplivant, and lipopeptides derived from cell-wall components such as PAM2CSK4, PAM3CSK4, and PAM3Cys.

TLR2 can form a heterodimer with TLR1 or TLR6, and accordingly, many TLR2 agonists are also TLR1 or TLR6 agonists.

The terms "TLR3" and "toll-like receptor 3" refer to any form of the TLR3 receptor, as well as variants, isoforms, and species homologs that retain at least a part of the activity of TLR3. Unless indicated differently, such as by specific reference to human TLR3, TLR3 includes all mammaila species of native sequence TLR3, e.g. human, monkey, and mouse. One exemplary human TLR3 is provided under UniProt Entry No. O15455.

"TLR3 agonist" as used herein means, any molecule, which upon binding to TLR3, (1) stimulates or activates TLR3, (2) enhances, increases, promotes, induces, or prolongs an activity, function, or presence of TLR3, or (3) enhances, increases, promotes, or induces the expression of TLR3. TLR3 agonists useful in the any of the treatment method, medicaments and uses of the present invention include, for example, nucleic acid ligands which bind TLR3.

Examples of TLR3 agonists that are useful in the treatment methods, medicaments, and uses of the present invention include TLR3 ligands such as synthetic dsRNA, polyinosinic-polycytidylic acid ["poly(I:C)"] (available from, e.g. InvivoGen in high molecular weight (HMW) and low molecular weight (LMW) preparations), polyadenylic-polyuridylic acid ["poly(A:U)"] (available from, e.g. InvivoGen), polyICLC (see Levy et al., Journal of Infectious Diseases, vol. 132, no. 4, pp. 434-439, 1975), Ampligen (see Jasani et al., Vaccine, vol. 27, no. 25-26, pp. 3401-3404, 2009), Hiltonol, Rintatolimod, and RGC100 (see Naumann et al., Clinical and Developmental Immunology, vol. 2013, article ID 283649).

The terms "TLR4" and "toll-like receptor 4" refer to any form of the TLR4 receptor, as well as variants, isoforms, and species homologs that retain at least a part of the activity of TLR4. Unless indicated differently, such as by specific reference to human TLR4, TLR4 includes all mammaila species of native sequence TLR4, e.g. human, monkey, and mouse. One exemplary human TLR4 is provided under UniProt Entry No. O00206.

"TLR4 agonist" as used herein means, any molecule, which upon binding to TLR4, (1) stimulates or activates TLR4, (2) enhances, increases, promotes, induces, or prolongs an activity, function, or presence of TLR4, or (3) enhances, increases, promotes, or induces the expression of TLR4. TLR4 agonists useful in the any of the treatment methods, medicaments and uses of the present invention include, for example, bacterial lipopolysaccharides (LPS) and derivatives thereof which bind TLR4.

Examples of TLR4 agonists that are useful in the treatment methods, medicaments, and uses of the present invention include, for example, bacterial lipopolysaccharides (LPS) and derivatives thereof such as B:0111 (Sigma), monophosphoryl lipid A (MPLA), 3DMPL (3-O-deacylated MPL), GLA-AQ, G100, AS15, ASO2, GSK1572932A (GlaxoSmithKline, UK).

The terms "TLR5" and "toll-like receptor 5" refer to any form of the TLR5 receptor, as well as variants, isoforms, and species homologs that retain at least a part of the activity of TLR5. Unless indicated differently, such as by specific reference to human TLR5, TLR5 includes all mammaila species of native sequence TLR5, e.g. human, monkey, and mouse. One exemplary human TLR5 is provided under UniProt Entry No. O60602.

"TLR5 agonist" as used herein means, any molecule, which upon binding to TLR5, (1) stimulates or activates TLR5, (2) enhances, increases, promotes, induces, or prolongs an activity, function, or presence of TLR5, or (3) enhances, increases, promotes, or induces the expression of TLR5. TLR5 agonists useful in the any of the treatment methods, medicaments and uses of the present invention include, for example, bacterial flagellins and derivatives thereof which bind TLR5.

Examples of TLR5 agonists that are useful in the treatment methods, medicaments, and uses of the present invention include, for example, bacterial flagellin purified from *B. subtilis*, flagellin purified from *P. aeruginosa*, flagellin purified from *S. typhimurium*, and recombinant flagellin (all available from InvivoGen), entolimod (CBLB502, a pharmacologically optimized flagellin derivative).

The terms "TLR6" and "toll-like receptor 6" refer to any form of the TLR6 receptor, as well as variants, isoforms, and species homologs that retain at least a part of the activity of TLR6. Unless indicated differently, such as by specific reference to human TLR6, TLR6 includes all mammaila species of native sequence TLR6, e.g. human, monkey, and mouse. One exemplary human TLR6 is provided under UniProt Entry No. Q9Y2C9.

"TLR6 agonist" as used herein means, any molecule, which upon binding to TLR6, (1) stimulates or activates TLR6, (2) enhances, increases, promotes, induces, or prolongs an activity, function, or presence of TLR6, or (3) enhances, increases, promotes, or induces the expression of TLR6. TLR6 agonists useful in the any of the treatment methods, medicaments and uses of the present invention include, for example, bacterial lipopeptides and derivatives thereof which bind TLR6.

Examples of TLR6 agonists that are useful in the treatment methods, medicaments, and uses of the present invention include, for example, many of the TLR2 agonists provided above, as TLR2 and TLR6 can form a heterodimer. TLR6 can also form a heterodimer with TLR4, and TLR6 agonists can include various TLR4 agonists provided above.

The terms "TLR7" and "toll-like receptor 7" refer to any form of the TLR7 receptor, as well as variants, isoforms, and species homologs that retain at least a part of the activity of TLR7. Unless indicated differently, such as by specific reference to human TLR7, TLR7 includes all mammaila species of native sequence TLR7, e.g. human, monkey, and mouse. One exemplary human TLR7 is provided under UniProt Entry No. Q9NYK1.

"TLR7 agonist" as used herein means, any molecule, which upon binding to TLR7, (1) stimulates or activates TLR7, (2) enhances, increases, promotes, induces, or prolongs an activity, function, or presence of TLR7, or (3) enhances, increases, promotes, or induces the expression of TLR7. TLR7 agonists useful in the any of the treatment method, medicaments and uses of the present invention include, for example, nucleic acid ligands which bind TLR7.

Examples of TLR7 agonists that are useful in the treatment methods, medicaments, and uses of the present invention include recombinant single-stranded ("ss")RNA, imidazoquinoline compounds such as imiquimod (R837), gardiquimod, and resiquimod (R848); Loxoribine (7-allyl-7,8-dihydro-8-oxo-guanosine) and related compounds; 7-Thia-8-oxoguanosine, 7-deazaguanosine, and related guanosine analogs; ANA975 (Anadys Pharmaceuticals) and related compounds; SM-360320 (Sumimoto); 3M-01, 3M-03, 3M-852, and 3M-S-34240 (3M Pharmaceuticals); GSK2245035 (GlaxoSmithKline; an 8-oxoadenine molecule), AZD8848 (AstraZeneca; an 8-oxoadenine molecule), MED19197 (Medimmune; formerly 3M-052), ssRNA40, and adenosine analogs such as UC-1V150 (Jin et al., Bioorganic Medicinal Chem Lett (2006) 16:4559-4563, compound 4). Many TLR7 agonists are also TLR8 agonists.

The terms "TLR8" and "toll-like receptor 8" refer to any form of the TLR8 receptor, as well as variants, isoforms, and species homologs that retain at least a part of the activity of TLR8. Unless indicated differently, such as by specific reference to human TLR8, TLR8 includes all mammaila species of native sequence TLR8, e.g. human, monkey, and mouse. One exemplary human TLR8 is provided under UniProt Entry No. Q9NR97.

"TLR8 agonist" as used herein means, any molecule, which upon binding to TLR8, (1) stimulates or activates TLR8, (2) enhances, increases, promotes, induces, or prolongs an activity, function, or presence of TLR8, or (3) enhances, increases, promotes, or induces the expression of TLR8. TLR8 agonists useful in the any of the treatment method, medicaments and uses of the present invention include, for example, nucleic acid ligands which bind TLR8.

Examples of TLR8 agonists that are useful in the treatment methods, medicaments, and uses of the present invention include recombinant single-stranded ssRNA, imiquimod (R837), gardiquimod, resiquimod (R848), 3M-01, 3M-03, 3M-852, and 3M-S-34240 (3M Pharmaceuticals); GSK2245035 (GlaxoSmithKline; an 8-oxoadenine molecule), AZD8848 (AstraZeneca; an 8-oxoadenine molecule), MED19197 (Medimmune; formerly 3M-052), Poly-G10, Motolimod, and various TLR7 agonists provided above (as previously noted, many TLR7 agonists are also TLR8 agonists).

The terms "TLR9" and "toll-like receptor 9" refer to any form of the TLR9 receptor, as well as variants, isoforms, and species homologs that retain at least a part of the activity of TLR9. Unless indicated differently, such as by specific reference to human TLR9, TLR9 includes all mammaila species of native sequence TLR9, e.g. human, monkey, and mouse. One exemplary human TLR9 is provided under UniProt Entry No. Q9NR96.

"TLR9 agonist" as used herein means, any molecule, which upon binding to TLR9, (1) stimulates or activates TLR9, (2) enhances, increases, promotes, induces, or prolongs an activity, function, or presence of TLR9, or (3) enhances, increases, promotes, or induces the expression of TLR9. TLR9 agonists useful in the any of the treatment method, medicaments and uses of the present invention include, for example, nucleic acid ligands which bind TLR9.

Examples of TLR9 agonists that are useful in the treatment methods, medicaments, and uses of the present invention include unmethylated CpG-containing DNA, immunostimulatory oligodeoxynucleotides (ODN), such as CpG-containing ODN such as CpG24555, CpG10103, CpG7909 (PF-3512676/agatolimod), CpG1018, AZD1419, ODN2216, MGN1703, SD-101, 1018ISS, and CMP-001. TLR9 agonists also include nucleotide sequences containing a synthetic cytosine-phosphate-2'-deoxy-7-deazaguanosine dinucleotide (CpR) (Hybridon, Inc.), dSLIM-30L1, and immunoglobulin-DNA complexes. Exemplary TLR9 agonists are disclosed in WO2003/015711, WO2004/016805, WO2009/022215, PCT/US95/01570, PCT/US97/19791, and U.S. Pat. Nos. 8,552,165, 6,194,388 and 6,239,116, which are each hereby incorporated by reference for all purposes.

RLRs include various cytosolic PRRs that detect, e.g. dsRNAs. Examples of RLRs include, for example, retinoic acid-inducible gene I (RIG-I), melanoma differentiation-associated gene 5 (MDA-5), and Laboratory of Genetics and Physiology 2 (LGP2).

"RLR agonist" as used herein means, any molecule, which upon binding to an RLR, (1) stimulates or activates the RLR, (2) enhances, increases, promotes, induces, or prolongs an activity, function, or presence of the RLR, or (3) enhances, increases, promotes, or induces the expression of RLR. RLR agonists useful in the any of the treatment methods, medicaments and uses of the present invention include, for example, nucleic acids and derivatives thereof which bind RLRs and agonistic monoclonal antibodies (mAb) which specifically binds to RLRs.

Examples of RLRs agonists that are useful in the treatment methods, medicaments, and uses of the present invention include, for example, short double-stranded RNA with uncapped 5' triphosphate (RIG-I agonist); poly I:C (MDA-5 agonist), and B0-112 (MDA-A agonist).

NLRs include various PRRs that detect, e.g. damage-associated moleculer pattern (DAMP) molecules. NLRs include the subfamilies NLRA-A, NLRB-B, NLRC-C, and NLRP-P. Examples of NLRs include, for example, NOD1, NOD2, NAIP, NLRC4, and NLRP3.

"NLR agonist" as used herein means, any molecule, which upon binding to an NLR, (1) stimulates or activates the NLR, (2) enhances, increases, promotes, induces, or prolongs an activity, function, or presence of the NLR, or (3) enhances, increases, promotes, or induces the expression of NLR. NLR agonists useful in the any of the treatment methods, medicaments and uses of the present invention include, for example, DAMPs and derivatives thereof which bind NLRs and agonistic monoclonal antibodies (mAb) which specifically binds to NLRs.

Examples of NLR agonists that are useful in the treatment methods, medicaments, and uses of the present invention include, for example, liposomal muramyl tripeptide/mifamurtide (NOD2 agonist).

CLRs include various PRRs that detect, e.g. carbohydrates and glycoproteins. CLRs include both transmembrane CLRs and secreted CLRs. Examples of CLRs include, for example, DEC-205/CD205, macrophage mannose receptor (MMR), Dectin-1, Dectin-2, mincle, DC-SIGN, DNGR-1, and mannose-binding lectin (MBL).

"CLR agonist" as used herein means, any molecule, which upon binding to a CLR, (1) stimulates or activates the CLR, (2) enhances, increases, promotes, induces, or prolongs an activity, function, or presence of the CLR, or (3) enhances, increases, promotes, or induces the expression of CLR. CLR agonists useful in the any of the treatment methods, medicaments and uses of the present invention include, for example, carbohydrates and derivatives thereof which bind CLRs and agonistic monoclonal antibodies (mAb) which specifically binds to CLRs.

Examples of CLR agonists that are useful in the treatment methods, medicaments, and uses of the present invention include, for example, MD-fraction (a purified soluble beta-glucan extract from *Grifola frondosa*) and imprime PGG (a beta 1,3/1,6-glucan PAMP derived from yeast).

The STING protein functions as both a cytosolic DNA sensor and an adaptor protein in Type 1 interferon signaling. The terms "STING" and "stimulator of interferon genes" refer to any form of the STING protein, as well as variants, isoforms, and species homologs that retain at least a part of the activity of STING. Unless indicated differently, such as by specific reference to human STING, STING includes all mammaila species of native sequence STING, e.g. human, monkey, and mouse. One exemplary human TLR9 is provided under UniProt Entry No. Q86WV6. STING is also known as as TMEM173.

"STING agonist" as used herein means, any molecule, which upon binding to TLR9, (1) stimulates or activates STING, (2) enhances, increases, promotes, induces, or prolongs an activity, function, or presence of STING, or (3) enhances, increases, promotes, or induces the expression of STING. STING agonists useful in the any of the treatment method, medicaments and uses of the present invention include, for example, nucleic acid ligands which bind STING.

Examples of STING agonists that are useful in the treatment methods, medicaments, and uses of the present invention include various immunostimulatory nucleic acids, such as synthetic double stranded DNA, cyclic di-GMP, cyclic-GMP-AMP (cGAMP), synthetic cyclic dinucleotides (CDN) such as MK-1454 and ADU-S100 (MIW815), and small molecules such as P0-424.

Other PRRs include, for example, DNA-dependent Activator of IFN-regulatory factors (DAI) and Absent in Melanoma 2 (AIM2).

Immunostimulatory cytokines include various signaling proteins that stimulate immune response, such as interferons, interleukins, and hematopoietic growth factors.

Exemplary immunostimulatory cytokines include GM-CSF, G-CSF, IFN-alpha, IFN-gamma; IL-2 (e.g. denileukin difitox), IL-6, IL-7, IL-11, IL-12, IL-15, IL-18, IL-21, and TNF-alpha.

Immunostimulatory cytokines may have any suitable format. In some embodiments, an immunostimulatory cytokine may be a recombinant version of a wild-type cyotkine. In some embodiments, an immunostimulatory cytokine may be a mutein that has one or more amino acid changes as compared to the corresponding wild-type cytokine. In some embodiments, an immunostimulatory cytokine may be incorporated into a chimeric protein containing the cytokine and at least one other functional protein (e.g. an antibody). In some embodiments, an immunostimulatory cytokine may covalently linked to a drug/agent (e.g. any drug/agent as described elsewhere herein as a possible ADC component).

Cancer vaccines include various compositions that contain tumor associated antigens (or which can be used to generate the tumor associated antigen in the subject) and thus can be used to provoke an immune response in a subject that will be directed to tumor cells that contain the tumor associated antigen.

Example materials that may be included in a cancer vaccine include, attenuated cancerous cells, tumor antigens, antigen presenting cells such as dendritic cells pulsed with tumor derived antigen or nucleic acids encoding tumor associated antigens. In some embodiments, a cancer vaccine may be prepared with a patient's own cancer cells. In some embodiments, a cancer vaccine may be prepare with biological material that is not from a patient's own cancer cells.

Cancer vaccines include, for example, sipuleucel-T and talimogene laherparepvec (T-VEC).

Immune cell therapy involves treating a patient with immune cells that are capable of targeting cancer cells. Immune cell therapy includes, for example, tumor-infiltrating lymphocytes (TILs) and chimeric antigen receptor T cells (CAR-T cells).

Examples of chemotherapeutic agents include alkylating agents such as thiotepa and cyclosphosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CBI-TMI), eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as the enediyne antibiotics (e.g., calicheamicin, especially calicheamicin gamma1I and calicheamicin phil1, see, e.g., Agnew, Chem. Intl. Ed. Engl., 33:183-186 (1994); dynemicin, including dynemicin A;

bisphosphonates, such as clodronate; an esperamicin; as well as neocarzinostatin chromophore and related chromoprotein enediyne antibiotic chromomophores), aclacinomysins, actinomycin, authramycin, azaserine, bleomycins, cactinomycin, carabicin, caminomycin, carzinophilin, chromomycins, dactinomycin, daunorubicin, detorubicin, 6-diazo-5-oxo-L-norleucine, doxorubicin (including morpholino-doxorubicin, cyanomorpholino-doxorubicin, 2-pyrrolino-doxorubicin, and deoxydoxorubicin), pegylated liposomal doxorubicin, epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidamine; maytansinoids such as maytansine and ansamitocins; mitoguazone; mitoxantrone; mopidamol; nitracrine; pentostatin; phenamet; pirarubicin; losoxantrone; podophyllinic acid; 2-ethylhydrazide; procarbazine; razoxane; rhizoxin; sizofuran; spirogermanium; tenuazonic acid; triaziquone; 2, 2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"), cyclophosphamide; thiotepa; taxoids, e.g., paclitaxel and doxetaxel; chlorambucil; gemcitabine; 6-thioguanine; mercaptopurine; methotrexate; platinum analogs such as cisplatin and carboplatin; vinblastine; platinum; etoposide (VP-16); ifosfamide; mitoxantrone; vincristine; vinorelbine; novantrone; teniposide; edatrexate; daunomycin; aminopterin; xeloda; ibandronate; CPT-11, topoisomerase inhibitor RFS 2000; difluoromethylornithine (DMFO); retinoids such as retinoic acid; capecitabine; and pharmaceutically acceptable salts, acids or derivatives of any of the above. Also included are antihormonal agents that act to regulate or inhibit hormone action on tumors such as anti-estrogens and selective estrogen receptor modulators (SERMs), including, for example, tamoxifen, raloxifene, droloxifene, 4-hydroxytamoxifen, trioxifene, keoxifene, LY117018, onapristone, and toremifene (Fareston); aromatase inhibitors that inhibit the enzyme aromatase, which regulates estrogen production in the adrenal glands, such as, for example, 4(5)-imidazoles, aminoglutethimide, megestrol acetate, exemestane, formestane, fadrozole, vorozole, letrozole, and anastrozole; and antiandrogens such as flutamide, nilutamide, bicalutamide, leuprolide, and goserelin; KRAS inhibitors; MCT4 inhibitors; MAT2a inhibitors; tyrosine kinase inhibitors such as sunitinib, axitinib; alk/c-Met/ROS inhibitors such as crizotinib, lorlatinib; mTOR inhibitors such as temsirolimus, gedatolisib; src/abl inhibitors such as bosutinib; cyclin-dependent kinase (CDK) inhibitors such as palbociclib, PF-06873600; erb inhibitors such as dacomitinib; PARP inhibitors such as talazoparib; SMO inhibitors such as glasdegib, PF-5274857; EGFR T790M inhibitors such as PF-06747775; EZH2 inhibitors such as PF-06821497; PRMT5 inhibitors such as PF-06939999; TGFR6r1 inhibitors such as PF-06952229; and pharmaceutically acceptable salts, acids or derivatives of any of the above. In specific embodiments, such additional therapeutic agent is bevacizumab, cetuximab, sirolimus, panitumumab, 5-fluorouracil (5-FU), capecitabine, tivozanib, irinotecan, oxaliplatin, cisplatin, trifluridine, tipiracil, leucovorin, gemcitabine, regorafinib or erlotinib hydrochloride.

In some embodiments, a GUCY2c antibody or CD3-GUCY2c bispecific antibody is used in conjunction with one or more other therapeutic agents targeting an immune checkpoint modulator or costimulatory agent, such as, for example without limitation, an agent targeting CTLA-4, LAG-3, B7-H3, B7-H4, B7-DC (PD-L2), B7-H5, B7-H6, B7-H8, B7-H2, B7-1, B7-2, ICOS, ICOS-L, TIGIT, CD2, CD47, CD80, CD86, CD48, CD58, CD226, CD155, CD112, LAIR1, 2B4, BTLA, CD160, TIM1, TIM-3, TIM4, VISTA (PD-H1), OX40, OX40L, GITR, GITRL, CD70, CD27, 4-1BB, 4-BBL, DR3, TL1A, CD40, CD40L, CD30, CD30L, LIGHT, HVEM, SLAM (SLAMF1, CD150), SLAMF2 (CD48), SLAMF3 (CD229), SLAMF4 (2B4, CD244), SLAMF5 (CD84), SLAMF6 (NTB-A), SLAMCF7 (CS1), SLAMF8 (BLAME), SLAMF9 (CD2F), CD28, CEACAM1 (CD66a), CEACAM3, CEACAM4, CEACAM5, CEACAM6, CEACAM7, CEACAM8, CEACAM1-3AS CEACAM3C2, CEACAM1-15, PSG1-11, CEACAM1-4C1, CEACAM1-4S, CEACAM1-4L, IDO, TDO, CCR2, CD39-CD73-adenosine pathway (A2AR), BTKs, TIKs, CXCR2, CXCR4, CCR4, CCR8, CCR5, CSF-1, or an innate immune response modulator.

In some embodiments, a GUCY2c antibody or CD3-GUCY2c bispecific antibody is used in conjunction with, for example, an anti-CTLA-4 antagonist antibody such as for example ipilimumab; an anti-LAG-3 antagonist antibody such as BMS-986016 and IMP701, an anti-TIM-3 antagonist antibody; an anti-B7-H3 antagonist antibody such as for example MGA271; an-anti-VISTA antagonist antibody; an anti-TIGIT antagonist antibody; antibody; an anti-CD80 antibody; an anti-CD86 antibody; an-anti-B7-H4 antagonist antibody; an anti-ICOS agonist antibody; an anti-CD28 agonist antibody; an innate immune response modulator (e.g., TLRs, KIR, NKG2A), and an IDO inhibitor.

In some embodiments, a GUCY2c antibody or CD3-GUCY2c bispecific antibody is used in conjunction with an OX40 agonist such as, for example, an anti-OX-40 agonist antibody. In some embodiments, a GUCY2c antibody or CD3-GUCY2c bispecific antibody is used in conjunction with a GITR agonist such as, for example, an-anti-GITR agonist antibody such as, for example without limitation, TRX518. In some embodiments, a GUCY2c antibody or CD3-GUCY2c bispecific antibody is used in conjunction with an IDO inhibitor. In some embodiments, a GUCY2c antibody or CD3-GUCY2c bispecific antibody is used in conjunction with a cytokine therapy such as, for example without limitation, IL-15, CSF-1, MCSF-1, etc.

In some embodiments, a GUCY2c antibody or CD3-GUCY2c bispecific antibody is used in conjunction with one or more other therapeutic antibodies, such as, for example without limitation, an antibody targeting CD19, CD22, CD40, CD52, or CCR4.

In certain embodiments, a GUCY2c antibody or CD3-GUCY2c bispecific antibody composition comprises at least one additional agent such as bevacizumab, cetuximb, sirolimus, panitumumab, 5-fluorouracil (5-FU), capecitabine, tivozanib, irinotecan, oxaliplatin, cisplatin, trifluridine, tipiracil, leucovori, gemcitabine and erlotinib hydrochloride.

In some embodiments, the GUCY2c antibody or CD3-GUCY2c bispecific antibody therapy may be co-administered with, or be sequentially administered before or after the other agent treatment by intervals ranging from minutes to weeks. In embodiments where the other agents and/or a proteins or polynucleotides are administered separately, one would generally ensure that a significant period of time did not expire between each delivery, such that the agent and the composition of the present invention would still be able to exert an advantageously combined effect on the subject. In such instances, it is contemplated that one may administer both modalities within about 12-24 h of each other and, more preferably, within about 6-12 h of each other. In some situations, it may be desirable to extend the time period for administration significantly, however, where several days (2, 3, 4, 5, 6 or 7) to several weeks (1, 2, 3, 4, 5, 6, 7 or 8) lapse between the respective administrations.

In some embodiments, a GUCY2c antibody or CD3-GUCY2c bispecific antibody composition is combined with a treatment regimen further comprising a traditional therapy selected from the group consisting of: surgery, radiation therapy, chemotherapy, targeted therapy, immunotherapy, hormonal therapy, angiogenesis inhibition and palliative care.

The composition used in the present invention can further comprise pharmaceutically acceptable carriers, excipients, or stabilizers (Remington: The Science and practice of Pharmacy 21st Ed., 2005, Lippincott Williams and Wilkins, Ed. K. E. Hoover), in the form of lyophilized formulations or aqueous solutions. Acceptable carriers, excipients, or stabilizers are nontoxic to recipients at the dosages and concentrations, and may comprise buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrans; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG). Pharmaceutically acceptable excipients are further described herein.

In one aspect, the present invention provides a method of producing an anti-GUCY2c antibody or a bispecific as disclosed herein, comprising culturing a host cell, under conditions that results in production of anti-GUCY2c antibody or a bispecific antibody as disclosed herein, and purifying the antibody or the bispecific antibody from the culture.

In another aspect, the present invention provide a use of an anti-GUCY2c antibody, a bispecific antibody, a pharmaceutical composition, a polynucleotide, a supernatant, vector, or a host cell as disclosed herein, in the manufacture of a medicament for detecting, diagnosing, and/or treating a GUCY2c associated disorder.

A further aspect of the invention is a kit comprising a GUCY2c antibody or CD3-GUCY2c bispecific antibody as disclosed hereinabove and instructions for use in accordance with any of the methods of the invention described herein. Generally, these instructions comprise a description of administration of the GUCY2c antibody or CD3-GUCY2c bispecific antibody for the above described therapeutic treatments. This kit comprises any pharmaceutical composition disclosed herein. The pharmaceutical compositions and other reagents may be present in the kits in any convenient form, such as, e.g., in a solution or in a powder form.

In another aspect, a kit further comprises one or more other prophylactic or therapeutic agents useful for the treatment of cancer, in one or more containers. In one embodiment, the other prophylactic or therapeutic agent is a chemotherapeutic. In other aspects, the prophylactic or therapeutic agent is a biological or hormonal therapeutic.

Several aspects of the pharmaceutical compositions, prophylactic, or therapeutic agents of the invention are preferably tested in vitro, in a cell culture system, and in an animal model organism, such as a rodent animal model system, for the desired therapeutic activity prior to use in humans.

Toxicity and efficacy of the prophylactic and/or therapeutic protocols of the instant invention maybe determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it may be expressed as the ratio $LD_{50}/ED_{50}$. Prophylactic and/or therapeutic agents that exhibit large therapeutic indices are preferred.

Further, any assays known to those skilled in the art may be used to evaluate the prophylactic and/or therapeutic utility of the therapies or combinatorial therapies disclosed herein for treatment or prevention of cancer.

The instructions relating to the use of the GUCY2c antibody or CD3-GUCY2c bispecific antibody as described herein generally include information as to dosage, dosing schedule, and route of administration for the intended treatment. The containers may be unit doses, bulk packages (e.g., multi-dose packages) or sub-unit doses. Instructions supplied in the kits of the invention are typically written instructions on a label or package insert (e.g., a paper sheet included in the kit), but machine-readable instructions (e.g., instructions carried on a magnetic or optical storage disk) are also acceptable.

The kits of this invention are in suitable packaging. Suitable packaging includes, but is not limited to, vials, ampules, tubes, bottles, jars, flexible packaging (e.g., sealed Mylar or plastic bags), and the like for each pharmaceutical composition and other included reagents, e.g., buffers, balanced salt solutions, etc., for use in administering the pharmaceutical compositions to subjects. Also contemplated are packages for use in combination with a specific device, such as an inhaler, nasal administration device (e.g., an atomizer) or an infusion device such as a minipump. A kit may have a sterile access port (for example the container may be an intravenous solution bag or a vial having a stopper pierceable by a hypodermic injection needle). The container may also have a sterile access port (for example the container may be an intravenous solution bag or a vial having a stopper pierceable by a hypodermic injection needle). At least one active agent in the composition is a GUCY2c antibody or CD3-GUCY2c bispecific antibody. The container may further comprise a second pharmaceutically active agent.

Normally, the kit comprises a container and a label or package insert(s) on or associated with the container.

Biological Deposits

Representative materials of the present invention were deposited in the American Type Culture Collection, 10801 University Boulevard, Manassas, Va. 20110-2209, USA, on 13, Feb. 2018. Vector GUCY2C-1608 Chain A (VH-Hole SEQ ID NO: 220) having ATCC Accession No. PTA-124943 comprises a DNA insert (SEQ ID NO: 247) encoding the VH-Hole chain of bispecific antibody GUCY2C-1608, and vector GUCY2C-1608 Chain B (VL-Knob SEQ ID NO: 216) having ATCC Accession No. PTA-124944 comprises a DNA insert (SEQ ID NO: 246) encoding the VL-Knob chain of bispecific antibody GUCY2C-1608.

The deposits were made under the provisions of the Budapest Treaty on the International Recognition of the Deposit of Microorganisms for the Purpose of Patent Procedure and Regulations thereunder (Budapest Treaty). This assures maintenance of a viable culture of the deposit for 30 years from the date of deposit. The deposit will be made available by ATCC under the terms of the Budapest Treaty, and subject to an agreement between Pfizer Inc. and ATCC, which assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 U.S.C. Section 122 and the Commissioner's rules pursuant thereto (including 37 C.F.R. Section 1.14 with particular reference to 886 OG 638). The assignee of the present application has agreed that if a culture of the materials on deposit should die or be lost or destroyed when cultivated under suitable conditions; the materials will be promptly replaced on notification with another of the same. Availability of the deposited material is not to be construed as a license to practice the invention in contravention of the rights granted under the authority of any government in accordance with its patent laws.

The following examples of specific aspects for carrying out the present invention are offered for illustrative purposes only, and are not intended to limit the scope of the present invention in any way.

EXAMPLES

Example 1

Immunization and Hybridoma Generation of Mouse GUCY2c Antibodies

The recombinant human GUCY2c protein immunogen or cells over-expressing human GUCY2c on the surface (SEQ ID NO: 224) were injected into Balb/c mice for the generation of hybridomas. Eight-week old female Balb/c mice were immunized with soluble huGUCY2c-mIgG2a protein or a 300.19 cell line expressing human GUCY2c (SEQ ID 224/225). For mice immunized with huGUCY2c recombinant protein, animals were dosed according to the RIMMS protocol (Kilpatrick, et al. Hybridoma. 1997. 16:381-389). Briefly, mice were immunized with six times recombinant human GUCY2c-mouse IgG2a Fc-fusion protein (SEQ ID NO: 230) in the course of two weeks through subcutaneous injection. The adjuvants used were complete and incomplete Freund's adjuvants. For cell-based immunization, Balb/c mice were immunized with $5\times10^6$ 300.19 cells over-expressing human GUCY2c twice per week for one month without adjuvant through i.p. injection. To determine the mouse GUCY2c antibody titers, test bleeds were collected from immunized animals and the GUCY2c specific titers were examined by enzyme-linked immunosorbent assay (ELISA) on recombinant human GUCY2c mIgG2a-Fc (SEQ ID NO: 230) and cynomolgus GUCY2c-mIgG2a-Fc (SEQ ID NO: 234). Animals with the highest GUCY2c titers were selected for hybridoma production. For the soluble recombinant protein immunized mice, LN lymphocytes and splenocytes were used for fusion, whereas only splenocytes were used for fusion for mice immunized with 300.19/hGUCY2c. For hybridoma production, splenocytes and/or lymph node lymphocytes were fused with P3X myeloma at 1:1 ratio using PEG. Fused cells were selected in the presence of HAT for seven days after which the hybridomas were maintained in HT-containing media prior to screening. To identify anti-huGUCY2c specific hybridomas, hybridoma supernatants were screened for IgG anti-huGUCY2c reactivity by ELISA. Potential anti-GUCY2c hybridomas were then consolidated and analyzed for reactivity for cell surface human and cyno GUCY2c on transfected 300.19 cell lines and primary tumor lines expressing GUCY2c. Briefly, 300.19 cell lines expressing various GUCY2c proteins (SEQ ID NOs: 224, 226 and 228) were seeded at $4\times10^4$ cells/well were seeded in sterile 96-well tissue culture plates (Becton Dickinson) on Day 1 and incubated at 37° C./5% $CO_2$ for 1-2 days until a confluent monolayer was observed. Cells were washed 4 times with PBS+$Ca^{2+}$ and $Mg^{2+}$ and blocked for 1 hour at room temperature with 3% milk/1% BSA/PBS+$Ca^{2+}$ and $Mg^{2+}$. Samples serially diluted (1:3 in blocking buffer) were applied to the plate. Plates were incubated at room temperature for 2 hours before being washed with PBS+$Ca^{2+}$ and $Mg^{2+}$. HRP-conjugated secondary antibody, goat anti-mouse IgG Fc (Thermo Scientific) diluted (1:4,000) in blocking buffer was then applied and incubated with cells for 1 hour. Plates were washed with PBS+$Ca^{2+}$ and $Mg^{2+}$ before being developed TMB substrate solution for 10 minutes, then 0.18M $H_2SO_4$ to stop the reaction. Absorbance at O. D. 450 nM was measured and data was plotted and analyzed with Microsoft Excel and Graphpad-Prism software. Hybridomas that specifically bound to human and cynomolgus GUCY2c were identified.

Example 2

Binding of Anti-GUCY2c Hybridoma Antibodies in Flow Cytometry and Immunohistochemistry Assays Anti-GUCY2c hybridoma antibodies were screened by flow cytometry for cell surface binding to human GUCY2c on T84 and HT55 tumor cells. HT29 cells were used as negative controls. Cells were dissociated with cell dissociation buffer (Sigma) and blocked on ice with PBS+3% BSA. Cells were stained on ice with primary antibody for 1 hour and then washed with cold PBS. 10 µg/ml of secondary antibody (PE conjugated anti-mouse secondary, Jackson Immunoresearch) was added on ice for hour. Cells were washed again with cold PBS and re-suspended in PBS and stained with DAPI for live/dead discrimination, and analyzed for GUCY2c binding on a BD LSRII Fortessa. Several clones were identified to show specific binding to GUCY2c expressing cell lines (T84 and HT55) and no binding to GUCY2c-negative cells (HT29).

Hybridomas from BALB/c mice immunized against GUCY2c were tested for immunoreactivity in formalin fixed paraffin embedded cell pellets. Cell pellets generated for this screen consisted of 300.19 parental cells, 300.19 cells over expressing mouse, cynomolgus macaque or human GUCY2c, one human colorectal cancer cell line expressing high endogenous levels of GUCY2c (T84) and one human colorectal cancer cell line negative for GUCY2c expression (HT29). Cell lines were fixed for 24 h in 10% neutral buffered formalin (Thermo Scientific) and centrifuged at 300×g for 4 minutes (m) to pellet. Formalin was removed and cells pellets were re-suspended gently with pre-warmed 50° C. Histogel (Thermo Scientific). Cell pellets embedded in Histogel were cooled at 4° C. for 1-2 h before being processed overnight in a VIP automated tissue processor (Tissue-Tek). Processed cell pellets were embedded in paraffin. Five micron sections of the cell microarray were cut, transferred to a water bath and placed on Superfrost Excell microscope slides (Fisher). Slides were allowed to dry overnight. After deparaffinization and rehydration of tissue sections, heat induced epitope retrieval was performed in the Retriever 2100 pressure cooker (Electron Microscopy Sciences) in Borg Decloaker buffer pH 9.5 (Biocare Medical) or pH 6.0 citrate buffer (Thermo Scientific) followed by cooling to room temperature (RT). Endogenous peroxidase activity was inactivated with Peroxidazed 1 (Biocare Medical) for 10 m. Non-specific protein interactions were blocked for 10 m with Background Punisher (Biocare Medical). Each hybridoma was incubated without dilution for 1 h under both heat induced epitope retrieval conditions. Sections were rinsed in TBS and hybridoma binding was detected with Envision+ Mouse HRP (DAKO) for 30 m. Slides were rinsed in TBS and immunoreactivity was developed with Betazoid DAB Chromogen Kit (Biocare Medical) for 5 m, followed by rinses in distilled water. Immunostained sections were briefly counterstained with CAT Hematoxylin (Biocare Medical), washed in tap water, dehydrated in graded alcohols, cleared in xylene, and coverslipped with Permount mounting medium (FisherChemicals). Slides were evaluated by a veterinary pathologist to assess immunoreactivity. Clones with immunoreactivity to human, cynomolgus monkey and mouse GUCY2c were identified in this screen.

The results of anti-GUCY2c hybridoma antibodies binding by flow cytometry and immunohistochemistry (IHC) are shown in Table 11.

TABLE 11

| Clone | Flow Cytometry Binding T84+ HT55+ HT29− | IHC binding (human GUCY2c) | IHC binding (cyno GUCY2c) | IHC binding (mouse GUCY2c) |
|---|---|---|---|---|
| 1A7 | + | + | + | − |
| 2D4 | + | | | |
| 4F2 | + | | | |
| 4F12 | + | | | |
| 4G3 | + | | | |
| 5G7 | + | | | |
| 9H3 | + | + | + | + |
| 20D11 | + | | | |
| 3H6 | + | | | |
| 18E10 | + | | | |

Example 3

Quantification of GUCY2c Expression Levels on Cell Lines

GUCY2c receptor density in cell lines was measured using the GUCY2C-9H3 clone conjugated at a 1:1 ratio to Phycoerythrin (Thermo Scientific). 1×105 cells were stained with 10 ug/ml of PE labeled anti-GUCY2c mAb for saturation binding. Cells were washed and resuspended in FACS buffer with DAPI, and acquired using BD LSRII Fortessa with FACS Diva software. QuantiBRITE PE labeled beads (BD) were used in the same acquisition PE voltage settings to calculate the number of PE labeled antibodies per cell (ABC) based on the PE geometric mean fluorescence intensity. GUCY2c receptor density measurements in human tumor cell lines are shown in Table 12. Cell lines with receptor densities for GUCY2c were characterized in this assay and were used in subsequent assays (e.g., cytotoxicity assays) to evaluate functional activity of CD3-GUCY2c bispecific antibodies.

TABLE 12

| Cell Line | Antibody Binding Capacity (ABC)/Cell |
|---|---|
| T84 | 8066.6 |
| LS1034 | 6007.7 |
| SNU16 | 3029.3 |
| HT55 | 2811.5 |
| SW1116 | 2650.7 |
| CACO-2 | 4214.6 |
| JHH7 | 2290 |
| LS174T | 1666.8 |
| ASPC-1 | 495.6 |

Example 4

Cloning and Sequencing of Anti-GUCY2c Hybridoma Antibodies

Hybridoma supernatants with confirmed cell surface binding activity were sub-cloned into mouse IgG1 format. RNA was extracted and the variable (V) region DNA sequences from the expressed antibodies were obtained via reverse transcription polymerase chain reaction (RT-PCR) cloning, as described below.

One to five million of the subcloned hybridoma cells were homogenized for total RNA isolation with QIAGEN RNAeasy Mini kit. First strand cDNA was then produced using SuperScript III RT kit (Invitrogen). Double stranded cDNAs for variable regions of anti-GUCY2c IgGs were subsequently generated and amplified by PCR using primers from the mouse IgG heavy chain (IgG1, IgG2a, IgG2b) and light chain (kappa or lambda) constant regions, as described below. PCR cycling conditions were 1 cycle at 95C for 1 min; 25 cycles at 95C for 1 min, 63C for 1 min and 72C for 1 min. The resulting RT-PCR products were cloned into TOPO-Blunt cloning vector (Invitrogen) and were sequenced.

Residues in a variable domain were numbered according Kabat, which is a numbering system used for heavy chain variable domains or light chain variable domains of the compilation of antibodies (Kabat et al., 1991, Sequences of Proteins of Immunological Interest, 5th Ed. Public Health Service, National Institutes of Health, Bethesda, Md.). Using this numbering system, the actual linear amino acid sequence may contain fewer or additional amino acids corresponding to a shortening of, or insertion into, a FR or CDR of the variable domain. For example, a heavy chain variable domain may include a single amino acid insert (residue 52a according to Kabat) after residue 52 of H2 and inserted residues (e.g., residues 82a, 82b, and 82c, according to Kabat) after heavy chain Framework (FR) residue 82. The Kabat numbering of residues may be determined for a given antibody by alignment at regions of homology of the sequence of the antibody with a "standard" Kabat numbered sequence. Various algorithms for assigning Kabat numbering are available. The algorithm implemented in the version 2.3.3 release of Abysis (www.abysis.org) is used herein to assign Kabat numbering to variable regions VL CDR1, VL CDR2, VL CDR3, VH CDR2, and VH CDR3. The AbM definition is used for VH CDR1. FR residues are antibody variable domain residues other than the CDR residues. A VH or VL domain framework comprises four framework sub-regions, FR1, FR2, FR3 and FR4, interspersed with CDRs in the following structure: FR1-CDR1-FR2-CDR2-FR3-CDR3-FR4.

Chimeric T cell bispecific proteins with mouse V regions and modified human IgG constant (hIgG1) regions were generated as follows: V region cDNAs from parental mouse TOPO vectors were sub-cloned into mammalian expression vectors comprised of a first and second heterodimer-promoting domain each having a cysteine linker (Linker 3), such as GCPPCP (SEQ ID NO: 192), and either a "knob" Fc chain (SEQ ID NO: 188) or a "hole" Fc chain (SEQ ID NO: 189). In this case, mouse anti-GUCY2c variable heavy (VH) regions (SEQ ID NOs: 11, 19, 26, 33, and 41) were fused in frame with a human anti-CD3 variable light (VL) region (SEQ ID NO: 84), separated by a linker, GGGSGGGG (SEQ ID NO: 190), and followed by another linker GCPPCP (SEQ ID NO: 192), connecting to the "hole" Fc chain (SEQ ID NO: 189). Mouse anti-GUCY2c VL regions (SEQ ID NOs: 92, 100, 104, 106, 112 and 119) were fused in frame with a linker, GGGSGGGG (SEQ ID NO: 190), a human anti-CD3 VH region (SEQ ID NO: 1), followed by a linker, GCPPCP (SEQ ID NO: 192), and a "knob" Fc chain (SEQ ID NO: 188). Fragments were amplified by standard PCR with primers incorporating 15-25 nucleotide overhangs that share homology with the destination vector for iso-thermal assembly (ITA) cloning. Fragments were recombined into the linearized vectors above using the Infusion ITA cloning kit (Clontech).

Ligations were then transformed into competent *E. coli* DH5α (Life Technologies) and grown overnight at 37C on agarose plates containing 100 μg/mL carbenicillin. Colonies were counted, picked and grown overnight in YT-broth+100 μg/mL carbenicillin and DNA isolated using standard methods. All DNA constructs were then sequenced on both strands prior to mammalian cell expression using conventional sequencing methods.

Example 5

Expression and Purification of Chimeric CD3-GUCY2c Bispecific Antibodies

Complimentary construct pairs (12.5 μg of each chain) were co-transfected into 25 mL log phase cultures containing 1 million cells/ml HEK 293 cells using the Expi-Fectamine™ 293 Transfection Kit (Life Technologies). 24 hours post-transfection, ExpiFectamine Transfection Enhancer was added and cells were allowed to grow an additional 4-5 days before harvesting. Spent cultures were then collected, centrifuged to remove cell debris then passed through a 20 μm filter.

Clarified conditioned media containing CD3-GUCY2c bispecific antibodies were then purified using Protein A affinity chromatography. Samples were loaded onto 0.45 mL micro columns (Repligen) pre-packed with MabSelect SuRe™ Protein A resin (GE Healthcare) using a liquid handler (Tecan). Bound protein was washed with PBS pH7.2, then eluted with 20 mM citric acid, 150 mM sodium chloride pH 3.5 and neutralized with 2M tris, pH 8.0. Samples were then de-salted into PBS pH 7.2 using G25 Sephadex drip columns (GE Healthcare) according to the manufacturer's methods. Purified proteins were analyzed for purity using analytical size exclusion chromatography with a Mab HTP column (Tosoh Bioscience) on an Aglient 1200 HPLC following the manufacturer's protocols. Concentrations were determined by measuring at OD280 nm using a micro spectrophotometer (Trinean).

Example 6

Recombinant Protein Binding Analysis

Proteins were screened for binding to recombinant human, cyno and mouse proteins by ELISA. Purified human, cynomolgus, murine GUCY2c ECD or human CD3 epsilon-delta proteins were coated on Nunc-Maxisorb 384-well ELISA plates at 1 μg/ml in 20 μl in PBS-CMF (calcium and magnesium free) at 4C. Plates were washed 3× with PBS+0.05% TWEEN20 and blocked with PBS+3% milk for 1 hr, shaking at RT. Blocking solution was removed and samples serially diluted in block were added and incubated for 1 hr shaking at RT. Plates were washed 3× as before and a secondary antibody was added (goat anti-hu IgG Fc-HRP—Southern Biotech L2047-05, 1:5000; goat anti-mouse IgG Fc-HRP—Thermo Scientific, diluted 1:4,000; or mouse anti-penta-HIS-HRP, Qiagen, 1:1000), followed by shaking for 1 hr at RT. Plates were washed as before and signal was developed using TMB, the reaction stopped with H2SO4 and the absorbance read at 450 nm on an Envision plate reader (Perkin Elmer). An alternative detection method was also periodically employed in place of TMB/H2SO4. Following addition and wash of primary, 20 μl per well of anti-human IgG Europium conjugate (Perkin Elmer EU-N1) diluted 1:1000 in DELFIA assay buffer (Perkin Elmer 1244-330) was added and incubated at RT for 1 hr. Plates were then washed 3 times with 1× DELFIA Wash Solution (Perkin Elmer 1244-114) and 20 μl per well of Enhancement solution (Perkin Elmer 1244-105) was added and incubated for 30 minutes. Time-resolved fluorescence was then measured at 320 and 615 nm using an EnVision® plate reader (EnVision® Multilabel Plate Reader, Perkin Elmer) following the manufacturer's methods.

To test bispecific binding to both GUCY2c and CD3, a sandwich ELISA was performed. Human CD3 epsilon-delta (SEQ ID NO: 242) was coated on Nunc-Maxisorb 384-well ELISA plates at 1 μg/ml in 20 μl in PBS-CMF (calcium and magnesium free) at 4° C. Plates were washed 3× with PBS+0.05% TWEEN20 and blocked with PBS+3% milk for 1 hr, shaking at RT. Blocking solution was removed and samples serially diluted in block were added and incubated for 1 hr shaking at RT. Plates were washed 3× as before and purified human, cynomolgus or murine GUCY2c ECD-mouse IgG2a Fc fusion protein was added to the plate at 1 μg/ml and incubated at RT, shaking for 1 hr. Plates were washed 3× as before and a secondary antibody was added (goat anti-mouse IgG Fc-HRP—Thermo Scientific, diluted 1:4,000), followed by shaking for 1 hr at RT. Plates were washed as before and signal was developed using TMB, the reaction stopped with H2SO4 and the absorbance read at 450 nm on an EnVision® plate reader (Perkin Elmer). An alternative detection method was also periodically employed in place of TMB/H2SO4. Following addition and wash of purified human, cynomolgus or murine GUCY2c ECD-mouse IgG2a Fc fusion protein, 20 µl per well of anti mu-IgG Europium conjugate (Perkin Elmer EU-N1) diluted 1:1000 in DELFIA assay buffer (Perkin Elmer 1244-330) was added and incubated at RT for 1 hr. Plates were washed 3× with DELFIA washing buffer and incubated 30 minutes with 20 µl of enhancement solution (Perkin Elmer 1244-105). Time-resolved fluorescence was then measured at 3240 and 615 nm using an EnVision® plate reader (Perkin Elmer) following the manufacturer's methods. Chimeric CD3-GUCY2c bispecific antibodies were screened for binding activity against recombinant human GUCY2c and human CD3 epsilon by ELISA. The top 6 hits demonstrated low or sub nM dual binding activity (Table 13).

TABLE 13

| Clone | human GUCY2C $EC_{50}$ (nM) | human CD3 $EC_{50}$ (nM) | Bispecific binding $EC_{50}$ (nM) | Negative Control $EC_{50}$ (nM) |
|---|---|---|---|---|
| GUCY2C-0074 | >100 | 1.128 | 4.051 | NB |
| GUCY2C-0077 | 27.53 | 0.8873 | 7.504 | NB |
| GUCY2C-0078 | 23.51 | 1.446 | 9.68 | NB |
| GUCY2C-0098 | 60.19 | 7.244 | 185.6 | NB |
| GUCY2C-0104 | >100 | 0.4179 | 2.479 | NB |
| GUCY2C-0105 | 79.76 | 0.3547 | 5.045 | NB |

Example 7

Bispecific Antibody Mediated T Cell Activity

Human PBMCs were isolated from healthy donor blood using Histopaque-177 (Sigma). Naïve T cells were isolated from PBMCs using a T cell enrichment kit from Stem Cell Technologies (negative selection of T cells). GUCY2c expressing T84 human tumor cells transfected with a luciferase expression construct were resuspended in R10 medium (RPMI, 10% FBS, 1% Penn/Strep, 3 ml of 45% glucose). T cells were also were resuspended in R10 media and added to T84 cells at an Effector to Target ratio (E:T ratio) either 10:1 or 5:1. The cells were treated with serial dilutions of GUCY2c bispecific antibodies or a negative control CD3 bispecific, and incubated at 37° C. for 48 hours, followed by measurement of luciferase signal using the neolite reagent (Perkin Elmer) using a Victor (Perkin Elmer). $EC_{50}$ values were calculated in Graphpad PRISM using four parameter non-linear regression analysis. Target negative HCT116 or HT29 cells did not show any GUCY2c bispecific-mediated cytotoxicity. The results of cell killing assays with chimeric CD3-GUCY2c bispecific antibodies (E:T ratio=10:1) are shown in Table 14. All CD3-GUCY2c bispecific antibodies showed specific and potent T cell-dependent cell killing of GUCY2c positive cells.

TABLE 14

| Clone | T84 tumor cell $EC_{50}$ (nM) |
|---|---|
| GUCY2C-0074 | 2.6 |
| GUCY2C-0077 | 28.7 |
| GUCY2C-0078 | 7.8 |
| GUCY2C-0098 | 0.41 |
| GUCY2C-0104 | 14.9 |
| GUCY2C-0105 | 7.51 |

The results of cell killing assays with humanized CD3-GUCY2c bispecific antibodies (E:T ratio=5:1) are shown in Table 15. All bispecific antibodies showed T cell dependent cytotoxicity in GUCY2c positive cells.

TABLE 15

| Clone | T84 tumor cell $EC_{50}$ (nM) |
|---|---|
| GUCY2C-0240 | 0.53 |
| GUCY2C-0247 | 0.07 |
| GUCY2C-1186 | 0.22 |
| GUCY2C-1467 | 0.2 |
| GUCY2C-1476 | 0.07 |
| GUCY2C-1478 | 0.24 |
| GUCY2C-1481 | 1.57 |
| GUCY2C-1512 | 0.57 |
| GUCY2C-1518 | 0.37 |
| GUCY2C-1526 | 0.13 |
| GUCY2C-1538 | 0.05 |
| GUCY2C-1554 | 12.6 |
| GUCY2C-1555 | 1.13 |
| GUCY2C-1556 | 5.04 |
| GUCY2C-1557 | 0.22 |
| GUCY2C-1590 | 11.07 |
| GUCY2C-1592 | 2.6 |
| GUCY2C-1608 | 0.19 |

Example 8

Epitope Binning by Octet

Bispecific proteins GUCY2C-0074, -0077, -0104, -0105, and -0098 were evaluated for competitive and non-competitive binding against human GUCY2c (SEQ ID NO: 224) using a tandem binning assay with an OctetRED 384 (ForteBio). Octet assays were conducted at room temperature. Biotinylated human GUCY2c was diluted to 10 µg/ml in calcium and magnesium free phosphate buffered saline (PBS) and captured on Streptavidin (SA) biosensors (18-5020, ForteBio) according to the manufacturer's instructions. The bispecific proteins were diluted to 300 nM in PBS. The GUCY2c coated biosensors were dipped into the first bispecific protein for 300 seconds then dipped into the second bispecific protein for 300 seconds. Each of the bispecific antibodies were tested in this pairwise combinatorial manner. Bispecific antibodies that compete for the same binding region on human GUCY2c were grouped into a single bin. The epitope binning by Octet of chimeric CD3-GUCY2c bispecific antibodies demonstrates unique epitope groups recognized by anti-GUCY2c binding domains (Table 16). The + symbols indicate competing epitopes; +/− symbols indicate partially overlapping epitopes; − symbols indicate non-competing epitopes; and NT indicate that comparison analysis was not tested.

TABLE 16

| Clone | GUCY2C-0074 | GUCY2C-0077 | GUCY2C-0098 | GUCY2C-0104 | GUCY2C-0105 |
|---|---|---|---|---|---|
| GUCY2C-0074 | + | | | | |
| GUCY2C-0077 | NT | + | | | |
| GUCY2C-0098 | + | +/− | + | | |
| GUCY2C-0104 | NT | + | +/− | + | |
| GUCY2C-0105 | NT | + | − | + | + |

Example 9

Humanization of Mouse GUCY2c Antibody Binding Domains

Humanization of mouse GUCY2c variable regions was performed using a CDR-graft strategy. Complementary DNAs (cDNA) containing human acceptor framework, VH3-7 (SEQ ID NO: 176) for heavy chain, and VK1-39 (SEQ ID NO: 180) for light chain, with anti-GUCY2c complementary determining regions (CDR) donor sequences were synthesized in vectors containing either human IgG1-3m constant region or the human kappa for the light chain. The heavy chain vector was comprised of the CH1 region (SEQ ID NO: 185), the hinge region (SEQ ID NO: 186), and the CH2-CH3 region which includes effector function mutations L234A, L235A and G237A (SEQ ID NO: 187; numbering according to the EU index). The light chain vector was comprised of the kappa CL domain (SEQ ID NO: 184). Back-mutations to mouse sequence in the framework regions of both the VH and VL regions were introduced and assessed for full recovery of binding activity. Alignment of the VH and VL regions of human acceptor framework, the parental mouse clones and fully active humanized variants are shown in Tables 17A, 17B, 18A and 18B below for clone GUCY2C-0098.

Back-mutations to mouse sequence in the framework regions of both the VH and VL regions were introduced and assessed for full recovery of binding activity. Alignment of the VH and VL regions of human acceptor framework, the parental mouse clones and the fully active humanized variant GUCY2C-0241 are shown in Tables 17A and 17B below for clone GUCY2C-0098.

TABLE 17A

| Clone | HFW1 | VH CDR1 | HFW2 |
|---|---|---|---|
| huIGHV3-7 | EVQLVESGGGLVQPGGSLRLSCAAS (SEQ ID NO: 5) | GFTFSSYWMS (SEQ ID NO: 177) (ABM); SYWMS (SEQ ID NO: 271) Kabat | WVRQAPGKGLEWVA (SEQ ID NO: 6) |
| GUCY2C-0098 | QVQLQQPGAELVKPGASVKLSCKAS (SEQ ID NO: 30) | GYTFTSYWMH (SEQ ID NO: 27) (ABM); SYWMH (SEQ ID NO: 259) (Kabat) | WVKQRPGQGLEWIG (SEQ ID NO: 16) |
| GUCY2C-0241 | EVQLVESGGGLVQPGGSLRLSCAAS (SEQ ID NO: 5) | GYTFTSYWMH (SEQ ID NO: 27) (ABM); SYWMH (SEQ ID NO: 259) (Kabat) | WVRQAPGKGLEWIG (SEQ ID NO: 49) |

TABLE 17B

| Clone | VH CDR2 | HFW3 | VH CDR3 |
|---|---|---|---|
| huIGHV3-7 | NIKQDGSEKYYVDSVKG (SEQ ID NO: 178) (Kabat); KQDGSE (SEQ ID NO: 272) Chothia | RFTISRDNAKNSLY LQMNSLRAEDTAV YYCAR (SEQ ID NO: 7) | None |
| GUCY2C-0098 | EIKPSNGLTNYIEKFKN (SEQ ID NO: 28) (Kabat); KPSNGL (SEQ ID NO: 264) (Chothia) | KATLTVDKSATTAY MQLSSLTAEDSAV YYCTR (SEQ ID NO: 31) | TITTTEGYWFFDV (SEQ ID NO: 29) |
| GUCY2C-0241 | EIKPSNGLTNYIEKFKN (SEQ ID NO: 28) (Kabat); KPSNGL (SEQ ID NO: 264) (Chothia) | RFTISVDKAKNSAY LQMNSLRAEDTAV YYCTR (SEQ ID NO: 61) | TITTTEGYWFFDV (SEQ ID NO: 29) |

Alignment of the VL region of the human acceptor framework, the parental mouse clone and the fully humanized variant are shown in Tables 18A and 18B for clone GUCY2C-0098. The CDRs based on Kabat numbering are underlined. Bold represents original, non-human germline amino acids present in the fully humanized clone.

TABLE 18A

| Clone | LFW1 | VL CDR1 | LFW2 |
|---|---|---|---|
| huIGKV1-39 | DIQMTQSPSSLSASVGDRVTITC (SEQ ID NO: 80) | RASQSISSYLN (SEQ ID NO: 181) | WYQQKPGKAPKLLIY (SEQ ID NO: 81) |
| GICU2C-0098 | DIVLTQSPASLAVSLGQRATISC (SEQ ID NO: 96) | RASESVDYYGTSLMQ (SEQ ID NO: 107) | WYQQKPGQPPKLLIY (SEQ ID NO: 110) |
| GICU2C-0241 | DIQLTQSPSSLSASVGDRVTITC (SEQ ID NO: 126) | RASESVDYYGTSLMQ (SEQ ID NO: 107) | WYQQKPGKAPKLLIY (SEQ ID NO: 81) |

TABLE 18B

| Clone | VL CDR2 | LFW3 | VL CDR3 |
|---|---|---|---|
| huIGKV1-39 | AASSLQS (SEQ ID NO: 182) | GVPSRFSGSGSGTDFTLTISSLQPEDFATYYC (SEQ ID NO: 82) | QQSYSTPYT (SEQ ID NO: 183) |
| GICU2C-0098 | AASNVES (SEQ ID NO: 108) | GVPARFSGSGSGTDFSLNIHPVEEDDIAMYFC (SEQ ID NO: 111) | QQTRKVYT (SEQ ID NO: 109) |
| GICU2C-0241 | AASNVES (SEQ ID NO: 108) | GVPSRFSGSGSGTDFTLTISSLQPEDFATYYC (SEQ ID NO: 82) | QQTRKVYT (SEQ ID NO: 109) |

Table 19 shows that humanized anti-GUCY2c binding domains as human IgG1 demonstrate retained binding to recombinant GUCY2c protein by ELISA.

TABLE 19

| Clone | Direct huGUCY2C binding (nM) |
|---|---|
| GUCY2C-0166 | 0.06935 |
| GUCY2C-0179 | 5.143 |
| GUCY2C-0193 | 0.2297 |
| GUCY2C-0210 | 8.961 |
| GUCY2C-0212 | 0.7694 |
| GUCY2C-0241 | 0.1605 |

Table 20 shows that humanized GUCY2c binding domains as CD3 bispecific antibodies demonstrate retained binding to recombinant human GUCY2c and human CD3 proteins simultaneously. GUCY2C-0240 is a humanized CD3 bispecific antibody version of GUCY2C-0166 IgG. GUCY2C-0247 and GUCY2C-0250 are humanized CD3 bispecific antibodies of GUCY2C-0241 with different anti-CD3 variable regions.

TABLE 20

| Clone | huCD3-huGUCY2C Sandwich ELISA (nM) |
|---|---|
| GUCY2C-0240 | 0.07992 |
| GUCY2C-0247 | 0.705 |
| GUCY2C-0250 | 76.9 |

Example 10

Further Humanization, and Optimization of GUCY2C Binding Domains Using Phage Display In certain embodiments, the substitution is human germline substitution in which a CDR residue is replaced with the corresponding human germline residue, to increase the human amino acid content and reduce potential immunogenicity of the antibody. For example, if human germline VH3-7 framework is used and the exemplary antibody GUCY2C-0241, then the alignment of the VH CDR1 of GUCY2C-0241 antibody (SEQ ID NO: 27) and human germline VH3-7 is as follows Table 21 (using the Kabat numbering system with the AbM definition of VH CDR1):

TABLE 21

| | Position | | | | | | | | | |
|---|---|---|---|---|---|---|---|---|---|---|
| | 26 | 27 | 28 | 29 | 30 | 31 | 32 | 33 | 34 | 35 |
| Human Germline VH3-7 | G | F | T | F | S | S | Y | W | M | S |
| GUGY2C-0241 | G | Y | T | F | T | S | Y | W | M | H |

For positions 26, 28, 29, 31, 32, 33, and 34 the human germline residue and the corresponding GUCY2C-0241 residue are the same and a germline substitution is not possible. For positions 27, 30, and 35 (bold and underlined), the human germline residue and the corresponding GUCY2C-0241 residue are different. Residues of GUCY2C-0241 at these positions may be replaced with the corresponding human germline VH3-7 residue to further increase the human residue content.

The antibody, or antigen-binding fragment thereof, may comprise a VH framework comprising a human germline VH framework sequence. The VH framework sequence can be from a human VH3 germline, a VH1 germline, a VH5 germline, or a VH4 germline. Preferred human germline heavy chain frameworks are frameworks derived from VH1, VH3, or VH5 germlines. For example, VH frameworks from the following germlines may be used: IGHV3-23, IGHV3-7, or IGHV1-69 (germline names are based on IMGT germline definition). Preferred human germline light chain frameworks are frameworks derived from VK or Vλ germlines. For example, VL frameworks from the following germlines may be used: IGKV1-39 or IGKV3-20 (germline names are based on IMGT germline definition). Alternatively or in addition, the framework sequence may be a human germline consensus framework sequence, such as the framework of human Vλ1 consensus sequence, VK1 consensus sequence, VK2 consensus sequence, VK3 consensus sequence, VH3 germline consensus sequence, VH1 germline consensus sequence, VH5 germline consensus sequence, or VH4 germline consensus sequence. Sequences of human germline frameworks are available from various public databases, such as V-base, IMGT, NCBI, or Abysis.

The antibody, or antigen-binding fragment thereof, may comprise a VL framework comprising a human germline VL framework sequence. The VL framework may comprise one or more amino acid substitutions, additions, or deletions while still retaining functional and structural similarity with the germline from which it was derived. In some aspects, the VL framework is at least 90%, at least 91%, at least 92%, at least 93%, at least 94%, at least 95%, at least 96%, at least 97%, at least 98%, at least 99%, or 100% identical to a human germline VL framework sequence. In some aspects, the antibody, or antigen-binding fragment thereof, comprises a VL framework comprising 1, 2, 3, 4, 5, 6, 7, 8, 9, 10 amino acid substitutions, additions or deletions relative to the human germline VL framework sequence.

The human germline VL framework may be the framework of DPK9 (IMGT name: IGKV1-39). The human germline VL framework may be the framework of DPK12 (IMGT name: IGKV2D-29). The human germline VL framework may be the framework of DPK18 (IMGT name: IGKV2-30). The human germline VL framework may be the framework of DPK24 (IMGT name: IGKV4-1). The human germline VL framework may be the framework of HK102_V1 (IMGT name: IGKV1-5). The human germline VL framework may be the framework of DPK1 (IMGT name: IGKV1-33). The human germline VL framework may be the framework of DPK8 (IMGT name: IGKV1-9). The human germline VL framework may be the framework of DPK3 (IMGT name: IGKV1-6). The human germline VL framework may be the framework of DPK21 (IMGT name: IGKV3-15). The human germline VL framework may be the framework of Vg_38K (IMGT name: IGKV3-11). The human germline VL framework may be the framework of DPK22 (IMGT name: IGKV3-20). The human germline VL framework may be the framework of DPK15 (IMGT name: IGKV2-28). The human germline VL framework may be the framework of DPL16 (IMGT name: IGLV3-19). The human germline VL framework may be the framework of DPL8 (IMGT name: IGLV1-40). The human germline VL framework may be the framework of V1-22 (IMGT name: IGLV6-57). The human germline VL framework may be the framework of human VX consensus sequence. The human germline VL framework may be the framework of human VX1 consensus sequence. The human germline VL framework may be the framework of human VX3 consensus sequence. The human germline VL framework may be the framework of human VK consensus sequence. The human germline VL framework may be the framework of human VK1 consensus sequence. The human germline VL framework may be the framework of human VK2 consensus sequence. The human germline VL framework may be the framework of human VK3 consensus sequence.

Paratope Determination of GUCY2c Antibodies by Augmented Binary Substitution

A method for determining critical CDR residues has been described, by which functional antibody variants are selected from a library containing either the human germline residue or the corresponding rodent residue at each CDR position except for CDR-H3 (Townsend et al., 2015, Proc. Natl. Acad. Sci. USA. 112(50):15354-15359). A phage scFv library was constructed in which all CDR positions except VH CDR3 of GUCY2C-0241 that differed from the human germline (VH3-7NK1-39) were randomized such that approximately 50% of the clones encoded the mouse GUCY2C-0241 amino acid and approximately 50% encoded the human germline amino acid at that position (Tables 17A, 17B, 18A and 18B). Libraries were prepared and subjected to 3-4 rounds of selection on human GUCY2c (SEQ ID NO: 232) as described below. Clones that retained binding to GUCY2c were recovered and their sequences determined.

From this experiment, positions at which the human sequence was observed in less than approximately 20% of the binding clones were defined as essential mouse residues. Mouse residues were preferentially retained at 25 positions (heavy chain residues H35, E50, P52a, S53, N54, G55, L56, T57, N58, I60, E61, K62, F63 and N65; light chain residues E27, V29, D30, L32, M33, Q34, N53, E55, T91, R92 and K93 according to the Kabat numbering system and the AbM definition is used for VH CDR1; Chothia numbering system used for VL CDR1) indicating that replacement of these residues by human germline residues was strongly disfavored. Mouse and human residues were found with similar frequency (defined as greater than 20% human content) at heavy chain residues 27 (FN) and 30 (S/T) and light chain residues 54 (L/V) and 94 (A/V; according to the kabat numbering system; the AbM definition is used for VH CDR1), indicating that the mouse sequence at these positions is not critical.

Additionally, framework (FW) residues previously requiring back-mutations to mouse amino acids (heavy chain positions I48 and G49, according to the Kabat numbering system) were included in the augmented binary substitution strategy. Following phage selection and screening, the human amino acid sequence for heavy chain framework position 48, was observed approximately 10% of the time suggesting that the back-mutation is preferred. Heavy chain position 49 contained the mouse amino acid residue 100% of the time suggesting that this back-mutation is essential. The frequency of mouse or human amino acid sequence at CDR or FW positions following augmented binary substitution are shown in Table 22. Table 22 demonstrates the frequency of incorporation of human amino acids in GUCY2C-0098 CDR positions tested by augmented binary substitution (using the Kabat numbering system and the AbM definition is used for VH CDR1, Chothia numbering system used for VL CDR1).

TABLE 22

| Site | GUCY2C-0098 mouse AA | human germline AA | starting library % human | binding clones % human |
|---|---|---|---|---|
| H27 | Y | F | 50 | 21 |
| H30 | T | S | 35 | 28 |
| H35 | H | S | 39 | 2 |
| H50 | E | N | 30 | 0 |
| H52A | P | Q | 46 | 0 |
| H53 | S | D | 33 | 0 |
| H54 | N | G | 37 | 0 |
| H55 | G | S | 41 | 1 |
| H56 | L | E | 39 | 0 |
| H57 | T | K | 46 | 0 |
| H58 | N | Y | 37 | 1 |
| H60 | I | V | 43 | 2 |
| H61 | E | D | 48 | 3 |
| H62 | K | S | 41 | 2 |
| H63 | F | V | 35 | 5 |
| H65 | N | G | 26 | 4 |
| L27 | E | Q | 48 | 12 |
| L29 | V | I | 46 | 4 |
| L30 | D | S | 28 | 2 |
| L32 | L | Y | 48 | 0 |
| L33 | M | L | 35 | 13 |
| L34 | Q | N | 20 | 6 |
| L53 | N | S | 20 | 2 |
| L54 | V | L | 50 | 26 |
| L55 | E | Q | 35 | 10 |
| L91 | T | S | 43 | 4 |
| L92 | R | Y | 57 | 2 |
| L93 | K | S | 48 | 10 |
| L94 | V | T | 46 | 24 |
| H48 | I | V | 26 | 10 |
| H49 | G | A | 48 | 0 |

Further Optimization of Anti-GUCY2c Binding Domains

Variants of anti-GUCY2c with improved stability were isolated by the following procedures. The VH and VL regions of humanized clone GUCY2C-0241 (SEQ ID NOs: 60 and 137) were synthesized as a single chain variable fragment (scFv) in a phage expressing vector containing C-terminal His6 and c-myc tags (Blue Heron). Random mutations were introduced into the VH and VL CDR domains by NNK soft randomization using (methods previously described in U.S. Pat. No. 9,884,921). Oligos designed to selectively mutate one CDR residue at a time were synthesized at a vendor (IDT) and then used to introduce changes in the nucleic acid template using methods previously described (Townsend et al., 2015, Proc. Natl. Acad. Sci. USA. 112(50):15354-15359). A mutation designed to eliminate a potential site of posttranslational modification (heavy chain G55E), which removes a potential NG asparagine deamidation site (Chelius et al., Anal. Chem. 77(18):6004-6011, 2005) was also incorporated in the oligo design. Mutated clones were picked and sent for sequencing to assess mutation frequency. These phage-expressing vectors containing mutagenized VH and VL CDR variants of GUCY2C-0241 (SEQ ID NOs: 60 and 137) were then pooled into small sub-libraries for phage display.

Recombinant human, cynomolgus and murine GUCY2c proteins were used during the selection and subsequent screening steps (SEQ ID NOs: 230, 232, 234, 236, 238 and 240). For selections involving biotinylated proteins, aliquots of phage pools described above and magnetic streptavidin beads (Dynabeads M-280 streptavidin) were blocked separately in 3% milk/PBS for 1 hour at room temperature, 60° C. or 65° C. in a rotary mixer (20 rpm). Following incubation at different temperatures, blocked phage pools were centrifuged at 4000 RPM for 10 minutes, supernatants were transferred to fresh tubes and mixed with 6% blocking buffer. Blocked phage were incubated with excess molar concentrations of the de-selection reagents (i.e., streptavidin beads containing no target, double stranded sDNA, Insulin and/or membrane extract reagents), incubated at room temperature for 1 hour on a rotary shaker (20 rpm), mixed with blocked streptavidin-magnetic beads and incubated for a further hour. The de-selected library was collected by pelleting the beads using a magnetic separator. Using a Kingfisher magnetic purification instrument (ThermoFisher, Springfield N.J., USA) biotinylated selection antigen (at various concentrations as indicated in Table 23) was incubated with the de-selected phage library in a 96-deep well plate for 1 hour at room temp with periodic mixing. Beads were separated using a magnetic separator on the Kingfisher instrument and washed 4 times with PBS/0.1% Tween20 and 3 times with PBS in separate 96-deep well plates. Bound phage were eluted by incubating with 100 mM triethylamine (TEA) for 8 minutes in a fresh 96-well plate followed by separation from the magnetic beads. Eluted phage were neutralized with 2 M Tris-HCl pH 7.5. Example of phage selection conditions for anti-GUCY2c binding domain optimization are shown in Table 23. Table 23 also shows the selection conditions used for phage display. Dslxn stands for the de-selection conditions used. SA=streptavidin; D=DNA; I=insulin; M=membrane extract proteins. Therm represents the thermal incubation performed prior to incubation with the target.

TABLE 23

| Round | | Condition |
|---|---|---|
| R1 | Branch | C1R1 |
| | Target | huGUCY2C |
| | Target Conc. | 10 nM |
| | Dslxn | SA, D, I, M |
| | Therm | None |
| R2 | Branch | C1R2A |
| | Target | cyGUCY2C |
| | Target Conc. | 1 nM |
| | Dslxn | SA, D, I, M |
| | Therm | 60 C. |
| R3 | Branch | C1R3A1 |
| | Target | huGUCY2C |
| | Target Conc. | 0.1 nM |
| | Dslxn | SA, D, I, M |
| | Therm | 65° C. |

Eluted phage was used to infect 10 ml of an E. coli ER2738 culture that had been grown to mid-logarithmic phase (corresponding to an $OD_{600}$ of ~0.5). Bacteria were infected with phage for 1 hour at 37° C. with shaking at 150 rpm, concentrated following a centrifugation step and plated on 2× YT agar bioassay plates containing 2% glucose and 100 µg/ml ampicillin (2×YTAG). Various dilutions of E. coli culture infected with either input or output phage were also plated on 2×YTAG agar to determine phage titers. Following overnight growth at 30° C., 10 ml of 2×YTAG medium was added to each bioassay plate and the cells were resuspended by scraping the bacterial lawn. Glycerol was added to this cell suspension to give a final concentration of 17% and stored in aliquots at −80° C. until further use. In order to rescue phage for the next round of selection, 100 µl of this cell suspension was used to inoculate 20 ml 2×YTAG medium, which was grown at 37° C. (300 rpm) to an $OD_{600}$ of 0.3-0.5. Cells were then super-infected with 3.3 µl of MK13K07 helper phage and incubated at 37° C. (150 rpm) for 1 hour. The cells were then centrifuged and the pellet re-suspended in a kanamycin/non-glucose containing medium (2× YT with 50 µg/ml kanamycin and 100 µg/ml ampicillin). This culture was grown overnight at 30° C. (300 rpm). Phage were harvested in the supernatant following centrifugation and were ready to use in the next round of selection as described above.

Preparation of Crude Periplasmic Material for Use in ELISAs

ScFv can be expressed either on the surface of a phage particle or in solution in the bacterial periplasmic space, depending upon the growth conditions used. To induce release of scFv into the periplasm, 96-deep well plates containing 2× YT media with 0.1% glucose/100 µg/ml ampicillin were inoculated from thawed glycerol stocks (one clone per well) using the QPix Colony picker (Molecular Devices) and grown at 37° C. (999 rpm) for ~4 hours. Cultures were induced with IPTG at a final concentration of 0.02 mM and grown overnight at 30° C. (999 rpm). The contents of the bacterial periplasm (peripreps) were released by osmotic shock. Briefly, plates were centrifuged and pellets were resuspended in 150 µl TES periplasmic buffer (50 mM Tris, 1 mM EDTA, 20% Sucrose, pH7.4), followed by the addition of 150 µl 1:5 TES:water and incubated on ice for 30 minutes. Plates were centrifuged for 20 minutes at 4000 RPM and the scFv-containing supernatant was harvested.

Competition ELISA

ELISA plates (NUNC-Maxisorb 460372) were coated with 1 µg/mL of the antigen of interest in PBS buffer overnight at 4° C. Coating solution was discarded and the plates were then blocked at room temperature for 2 hours with 70 µL PBS-3% BSA per well. Blocking solution was discarded and 20 µL of primary antibody which was a mixture of unknown sample as peripreps or purified protein (at pre-determined dilution, typically 1:5) and pure parental antibody at desired concentration (typically at $EC_{50}$-$EC_{80}$). Plates were incubated for 2 hours at room temperature by slow shaking. Plates were washed 5 times with 100 µL per well of washing buffer (Perkin Elmer 1244-114) and incubated for 1 hour with 20 µL of secondary Europium conjugate diluted 1:1000 in Delfia assay buffer (Perkin Elmer 1244-111) for streptavidin-Eu or anti-human IgG, diluted 1:500 for anti-mouse IgG. Plates were washed 5 times as before and incubated for 30 minutes with 20 µL of enhancement solution (Perkin Elmer 1244-105). Time-resolved fluorescence was then measured at 320 and 615 nm using an EnVision® plate reader (EnVision® Multilabel Plate Reader, Perkin Elmer) following the manufacturer's methods.

ScFv Conversion to scFv-Fc, IgG and Bispecific Antibody

ScFv demonstrating desired behavior were selected for sub-cloning into scFv-Fc, where the Fc domain of human IgG1 was attached to the 3' end of the scFv. Briefly, fragments were amplified by standard polymerase chain reaction (PCR) with primers BssHII for 5' amplification and BcII for 3' amplification. Fragments were cut with corresponding restriction enzymes according to manufacturer's specifications (New England Biolabs). Anti GUCY2c scFv-Fc amplicons were gel purified (Qiagen Gel Purification Kit) and ligated into Pfizer's proprietary pre-cut mammalian expression vector containing the human IgG1 Fc domain. ScFv-Fc constructs were transformed into E. coli and sequenced as before. Sequence verified expression vectors were then used for transient mammalian expression in HEK 293 cells as described previously. Samples were purified using Protein A affinity capture followed by buffer exchange into PBS as described previously. Purified samples were then screened for recombinant GUCY2c protein binding activity and for stability. An example of an scFv-Fc sequence is GUCY2C-0405 (SEQ ID NO: 213). This format consists of an scFv in the VH-VL orientation connected by Linker 4, which is a glycine-serine linker (SEQ ID NO: 193). The VH-VL is connected to a modified human IgG1 Fc domain (SEQ ID NO: 187) using two linker sequences, Linker 5 (SEQ ID NO: 194) and Linker 6 (SEQ ID NO: 195).

Optimized scFv were also sub-cloned into human IgG1 and T cell bispecific formats as previously described. Variable region gene-specific primers were designed for ITA cloning as before.

Example 11

Surface Plasmon Resonance of Optimized GUCY2c Antibodies

Optimized GUCY2c antibodies were assessed for binding by surface plasmon resonance using a BIACORE™ 8K instrument (GE Healthcare). Using a CM5 Sensor Chip anti-human Fc (GE BR-1008-39) was first coated following the manufacturer's protocol. The human anti-GUCY2c IgG were run over the chip for 30 sec at 0.5 ug/mL, 10 uL/min in Hank's buffered saline (HBS)–EP+pH=7.4. Next, human GUCY2c protein (SEQ ID NO: 224) at concentrations of 450 nM, 150 nM and 50 nM was allowed to associate by running over the chip for 54 sec at 50 uL/min, then dissociate for 300 sec. The chip was regenerated between each run with 3×3M MgCl2 for 30 sec at 5 BIACORE™) binding affinity (nM $K_D$) to human GUCY2c recombinant protein of optimized anti-GUCY2c binding domains in human IgG1 format are shown in Table 24. Several optimized GUCY2c binding domains such as GUCY2C-0486 (SEQ ID Nos: 214 and 215) show improved binding affinity compared to the parental, non-optimized binding domain (GUCY2C-0241).

TABLE 24

| Clone | huGUCY2C $K_D$ (nM) |
|---|---|
| GUCY2C-0210 | 85.67 ± 2.76 |
| GUCY2C-0212 | 25.98 ± 0.01 |
| GUCY2C-0241 | 9.81 |
| GUCY2C-0456 | 13.75 |
| GUCY2C-0478 | 29.85 ± 0.26 |
| GUCY2C-0483 | 6.92 ± 0.13 |
| GUCY2C-0486 | 5.47 ± 0.07 |

Example 12

Thermal Challenge Binding Assay

To assess improved thermal stability of the optimized variants, either periplasmic preparations of optimized phage clones (described above) or purified proteins were assessed for binding activity following a thermal challenge at elevated temperatures in a PCR block. Greiner bio-one 384-well white ELISA plates (781074) were coated with 1 µg/ml of target protein in coating buffer (25 mM Na2CO3, 75 mM NaHCO3 pH 9.6) O/N at 4° C. Plates were washed 3 times with PBS+0.05% TWEEN20 and then blocked for 1 hr at RT shaking with blocking buffer (PBS+3% milk). Separately, dilution plates of periplasmic preparations or purified protein were prepared at either 1:10 of preplasmic preparations or 1 µg/ml (EC80) of recombinant protein binding at room temperature, in blocking buffer and 100 µl were transferred to a 96-well PCR plate. The PCR plate containing 100 µl diluted sample was then heated at the desired temperatures (generally between 55° C. and 75° C.) for 30 minutes. The plates were allowed to cool for 15 minutes at room temperature and then centrifuged at 4000 rpm for 10 minutes. The blocked ELISA plates were emptied and 20 µl of the thermally challenged protein supernatant was added per well, then incubated for 1 hr, shaking at RT. The plates were washed 3 times as before and 20 µl of an anti-6×HIS-Europium reagent (Perkin Elmer EU-N1) or an anti-human IgG-Europium conjugate reagent protein (Perkin Elmer EU-N1) diluted 1:1000 in DELFIA assay buffer (Perkin Elmer 1244-330) was added per well and incubated at RT for 1 hr with shaking. The plates were washed 3 times with 1×DELFIA Wash Solution (Perkin Elmer 1244-114) and 20 µl of Enhancement solution (Perkin Elmer 1244-105) was added to each well and incubated for 30 minutes. The plates were read on an Envision plate reader for time-resolved fluorescence first at OD320 then at OD615 following the manufacturer's methods. The temperature where 50% of activity is retained is reported as T50. The thermal binding assay for stability optimized GUCY2c binding domains as scFv-Fc demonstrated improved thermal stability following incubation at elevated temperatures compared to non-optimized parental clone GUCY2C-0241 (here as GUCY2C-0295 in scFv-Fc format) (Tables 25A and 25B).

Tables 25A and 25B show the time-resolved fluorescence (TRF) for optimized GUCY2c binding domains (as scFv-Fc proteins) at increasing temperature. The T50 value represents the temperature where the clone retains 50% binding activity.

TABLE 25A

| Clone | 50° C. | 50.5° C. | 51.7° C. | 53.2° C. | 55.5° C. | 58.4° C. | 61.8° C. |
|---|---|---|---|---|---|---|---|
| GUCY2C-0295 | 113537.5 | 68863 | 40896 | 27068 | 21936 | 21409.5 | 21197 |
| GUCY2C-0389 | 497589.5 | 517068 | 495444.5 | 397372 | 464052 | 150312.5 | 78680 |
| GUCY2C-0393 | 477566.5 | 511271 | 501945.5 | 480373.5 | 451437.5 | 77154.5 | 3630.5 |
| GUCY2C-0401 | 506357.5 | 526131 | 535157.5 | 517779 | 523479 | 525247 | 469885.5 |
| GUCY2C-0403 | 488139.5 | 544047.5 | 526733 | 536576 | 526171.5 | 522549.5 | 506987.5 |
| GUCY2C-0411 | 471676.5 | 522040 | 542235 | 531706 | 539339 | 515333.5 | 425089 |
| GUCY2C-0413 | 574068 | 598919 | 607913.5 | 603587.5 | 606227 | 590548 | 562273.5 |
| GUCY2C-0418 | 547580 | 567189.5 | 526030.5 | 539879 | 526607 | 492907.5 | 407950 |
| GUCY2C-0421 | 515013 | 487958.5 | 511088.5 | 510749 | 547231.5 | 529472 | 527035.5 |
| GUCY2C-0423 | 411893.5 | 399052.5 | 462363.5 | 343803 | 464695.5 | 363302 | 8103 |
| GUCY2C-0425 | 484807 | 479583 | 556277.5 | 510768 | 551751.5 | 548408 | 527384.5 |
| GUCY2C-0427 | 512520 | 546980.5 | 547056 | 523887.5 | 537909.5 | 533628 | 498146 |
| GUCY2C-0428 | 517436.5 | 541570.5 | 548392.5 | 536214.5 | 536255.5 | 523982.5 | 507148 |
| GUCY2C-0435 | 487047.5 | 528185 | 517133.5 | 489329 | 490196.5 | 326153.5 | 42327 |
| GUCY2C-0439 | 628296 | 568971 | 578626.5 | 576348.5 | 591356 | 585622 | 597929.5 |
| GUCY2C-0445 | 536524 | 543057.5 | 522756 | 529305.5 | 529928 | 461742 | 36773.5 |
| GUCY2C-0447 | 489262.5 | 499721 | 483027.5 | 484959 | 490929.5 | 470553.5 | 424560.5 |
| GUCY2C-0448 | 565712.5 | 572475 | 566258 | 558343.5 | 560063 | 559518 | 547452 |
| GUCY2C-0450 | 579746.5 | 595076.5 | 582737 | 578649.5 | 574037.5 | 563058.5 | 555110.5 |
| GUCY2C-0451 | 564219.5 | 565212 | 541781 | 561199.5 | 534570 | 542623 | 528037 |

TABLE 25B

| Clone | 64.6° C. | 66.8° C. | 68.1° C. | 69.6° C. | 70° C. | T50 |
|---|---|---|---|---|---|---|
| GUCY2C-0295 | 9853.5 | 1922 | 594 | 642.5 | 464.5 | 50.41 |
| GUCY2C-0389 | 51040.5 | 21131.5 | 5766 | 2710.5 | 640.5 | 57.98 |
| GUCY2C-0393 | 1677 | 909.5 | 2306 | 532 | 745.5 | 57.65 |
| GUCY2C-0401 | 26531 | 3014.5 | 3061.5 | 2215 | 1178.5 | 62.77 |
| GUCY2C-0403 | 498400.5 | 448403.5 | 298626.5 | 158161.5 | 77527 | 68.01 |
| GUCY2C-0411 | 52317 | 20580 | 5945.5 | 1917 | 1162 | 62.44 |
| GUCY2C-0413 | 573518.5 | 541790.5 | 469893 | 256224 | 108873 | 68.65 |
| GUCY2C-0418 | 231526 | 136359 | 41704 | 7131.5 | 2812.5 | 62.23 |
| GUCY2C-0421 | 489965 | 156593 | 1903.5 | 1135 | 980.5 | 66.44 |
| GUCY2C-0423 | 2270.5 | 1542.5 | 785.5 | 879.5 | 929.5 | 59.23 |
| GUCY2C-0425 | 494844.5 | 160062.5 | 2404.5 | 944 | 804 | 66.45 |
| GUCY2C-0427 | 486978 | 224510 | 2906.5 | 1084 | 902.5 | 66.67 |
| GUCY2C-0428 | 476739 | 96235.5 | 2133.5 | 1663.5 | 1332.5 | 66.1 |
| GUCY2C-0435 | 17360 | 2504.5 | 1119.5 | 820.5 | 1061.5 | 58.65 |
| GUCY2C-0439 | 562458.5 | 469494 | 249716.5 | 35294 | 6786.5 | 67.88 |
| GUCY2C-0445 | 9384.5 | 1404.5 | 372.5 | 318.5 | 416 | 59.21 |
| GUCY2C-0447 | 241324.5 | 12424.5 | 1271 | 391.5 | 1092.5 | 64.6 |
| GUCY2C-0448 | 510974.5 | 221540 | 2645 | 724.5 | 648 | 66.62 |
| GUCY2C-0450 | 518052.5 | 131373 | 1147 | 468.5 | 593 | 66.26 |
| GUCY2C-0451 | 496304.5 | 189156 | 1814.5 | 693.5 | 731.5 | 66.53 |

The amino acid sequences for the GUCY2c antibody clones showing improved thermal stability were compared against the parental clone GUCY2C-0241 (VH SEQ ID NO: 60 and VL SEQ ID NO: 137). Changes to amino acid content in VH CDRs leading to improved stability are shown in Table 26A. Changes in positions 59, 60, 61 and 62 appeared to have the greatest impact on stability, correlating with the largest changes in stability (according to the numbering system of Kabat, using the AbM definition for VH CDR1).

TABLE 26A

| | Position | Parent Amino Acid | Optimized Amino Acid |
|---|---|---|---|
| VH CDR1 | 30 | T | G |
| | 31 | S | N |
| | 32 | Y | D |
| VH CDR2 | 59 | Y | V, I, L |
| | 60 | I | N, H, A, S, G |
| | 61 | E | D, P |
| | 62 | K | Q, R, T |
| VH CDR3 | 95 | T | L |
| | 96 | I | V |
| | 97 | T | L, M |
| | 98 | T | K |
| | 99 | T | P, K, A, S, R |

Changes to amino acid content in VL CDRs leading to improved stability are shown in Table 26B (the numbering system of Chothia was used for VL CDR1 and the numbering system of Kabat was used for VL CDR2 and CDR3. Changes in positions 53, 54, 55 in VL CDR2 and positions 93 and 94 in VL CDR3 appeared to have the greatest impact on stability, correlating with the largest changes in stability.

TABLE 26B

| | Position | Parent Amino Acid | Optimized Amino Acid |
|---|---|---|---|
| VH CDR1 | 24 | R | T, K |
| | 30a | Y | W, A |
| | 30d | T | S, H, A, R, N |
| | 33 | M | L |
| | 34 | Q | H |
| VH CDR2 | 50 | A | G |
| | 51 | A | G |
| | 52 | S | T, H |
| | 53 | N | K, H |
| | 54 | V | L, R, I, G, K, T |
| | 55 | E | A, Y, W, V |
| | 56 | S | P, T, A |
| VH CDR3 | 89 | Q | M, L, N |
| | 91 | T | S, N |
| | 93 | K | R, N, Q, S |
| | 94 | V | A, E, G, D, I, Q |
| | 97 | T | S |

Example 13

Recombinant Protein Binding of Optimized CD3-GUCY2c Bispecific Antibodies

Optimized anti-GUCY2c binding domains were evaluated in bispecific format for simultaneous recombinant protein binding to human GUCY2c (SEQ ID NO: 224) and human CD3 (SEQ ID NO: 242) at room temperature and 60° C. using the DELFIA method described previously. Optimized bispecific antibodies were also evaluated for direct binding to human GUCY2c (SEQ ID NO: 232) and cynomolgus GUCY2c (SEQ ID NO: 236) at room temperature and 60° C. using the DELFIA method described previously. Dual binding of optimized GUCY2c bispecific antibodies to human GUCY2c and human CD3 are shown in Table 27. Optimized CD3-GUCY2c bispecific antibodies such as GUCY2C-1478 show strong binding at both room temperature and 60° C.

TABLE 27

| Clone | Sandwich huCD3-huGUCY DELFIA RT (@1 ug/ml) | Sandwich huCD3-huGUCY DELFIA 60 C. (@1 ug/ml) |
| --- | --- | --- |
| GUCY2C-1186 | 536148 | 137679 |
| GUCY2C-1467 | 830590 | 620774 |
| GUCY2C-1476 | 860194.5 | 682977.5 |
| GUCY2C-1478 | 833155.5 | 727935 |
| GUCY2C-1481 | 790943.5 | 694815.5 |
| GUCY2C-1512 | 800436 | 673743.5 |
| GUCY2C-1518 | 430465 | 87434.5 |
| GUCY2C-1526 | 568727.75 | 147975 |
| GUCY2C-1527 | 405448.25 | 67409 |
| GUCY2C-1538 | 617581 | 151603 |
| GUCY2C-1554 | 138640 | 14584 |
| GUCY2C-1555 | 353355.25 | 68362.25 |
| GUCY2C-1556 | 217761.5 | 40731.75 |
| GUCY2C-1557 | 473322 | 190626.25 |
| GUCY2C-1590 | 165141 | 71515 |
| GUCY2C-1591 | 422409.25 | 159723.25 |
| GUCY2C-1592 | 262425.75 | 79415.75 |
| GUCY2C-1608 | 523911.5 | 192704.5 |

The results of direct binding of optimized GUCY2c bispecific antibodies to human and cynomolgus GUCY2c are shown in Table 28. Optimized CD3-GUCY2C bispecific antibodies such as GUCY2C-1478 demonstrate strong binding at room temperature to both human and cyno GUCY2c, while showing some loss of binding signal following incubation at 60° C.

TABLE 28

| Clone | huGUCY2C RT $EC_{50}$ (nM) | CyGUCY2C RT $EC_{50}$ (nM) | huGUCY2C 60 C. $EC_{50}$ (nM) | CyGUCY2C 60 C. $EC_{50}$ (nM) |
| --- | --- | --- | --- | --- |
| GUCY2C-1478 | 4.387 | 4.902 | 19.24 | 15.65 |
| GUCY2C-1481 | 7.836 | 8.34 | 27.36 | 64.99 |
| GUCY2C-1554 | 18.32 | 13.93 | NB | NB |
| GUCY2C-1555 | 5.391 | 6.85 | 39.44 | 94.86 |
| GUCY2C-1556 | 13.58 | 10.14 | 65.58 | 62.41 |
| GUCY2C-1557 | 6.382 | 7.51 | 38.2 | 53.52 |
| GUCY2C-1590 | 20.25 | 13.31 | 48.65 | 57.3 |
| GUCY2C-1592 | 13.38 | 14.39 | 94.09 | 75.97 |
| GUCY2C-1608 | 8.775 | 9.835 | 23.67 | 49.87 |
| Negative Control | NB | NB | NB | NB |

Example 14

Cell Binding of CD3-GUCY2c Bispecific Antibodies by Flow Cytometry

Figure 1A:
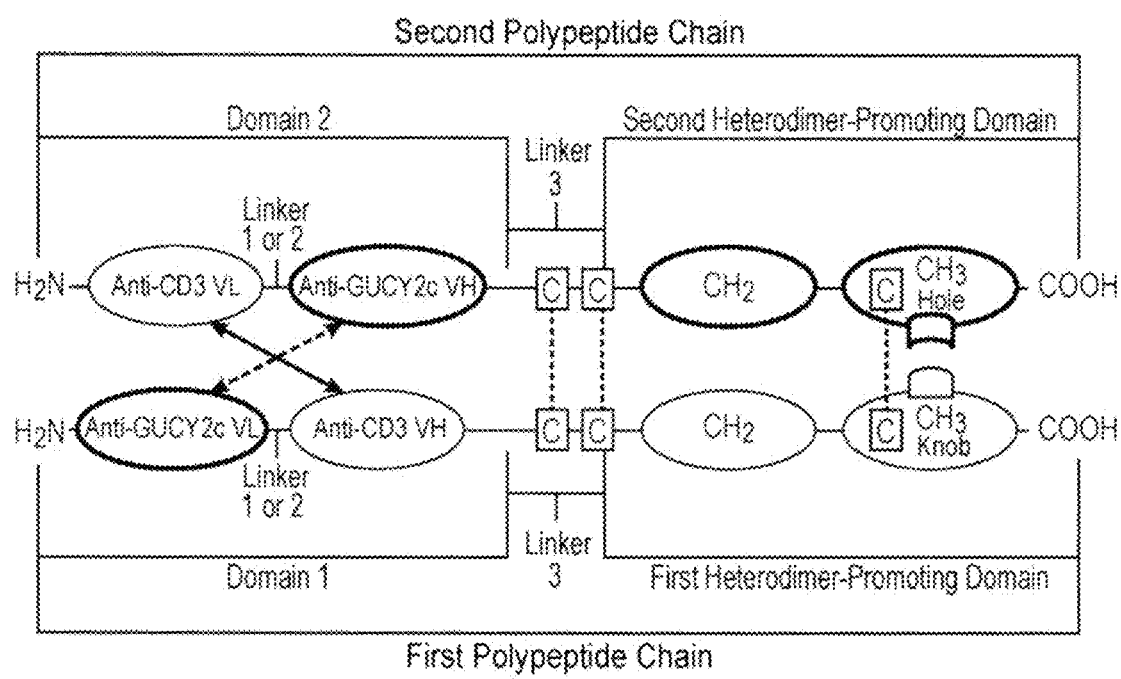
FIGS. 1A, 1B, 1C and 1D depict schematics of four alternative representations of CD3-GUCY2c bispecific antibodies having a first heterodimer-promoting domain and second heterodimer-promoting domain comprising an Fc chain optimized to associate via a "knob-in-hole" association.
Figure 1B:
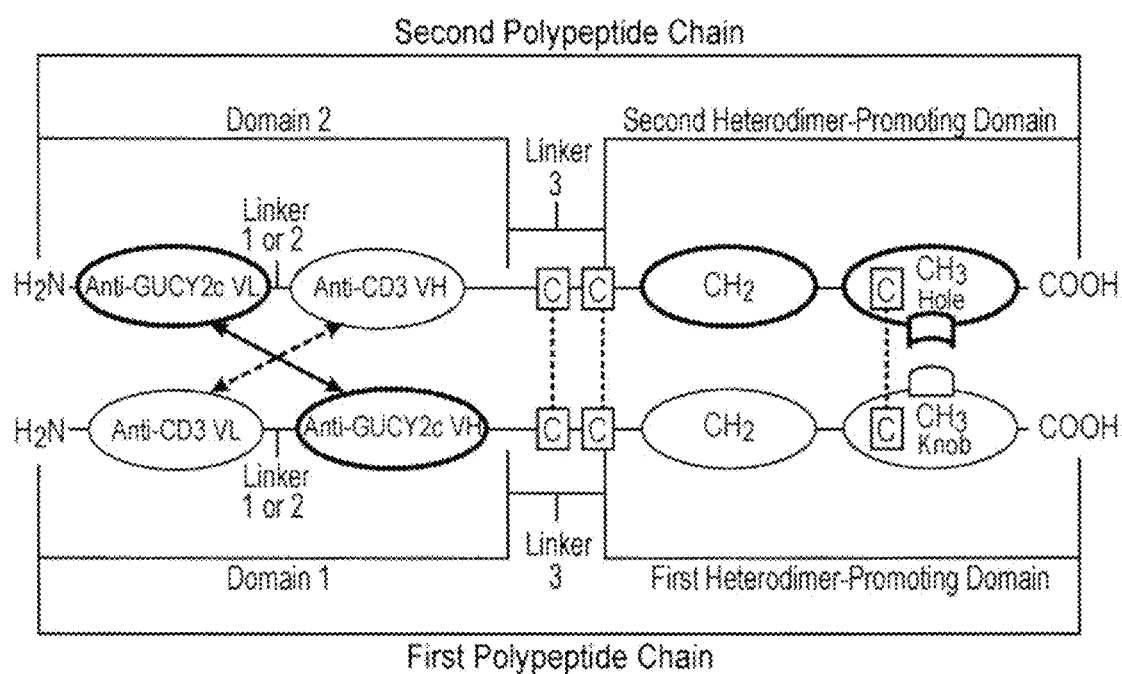
Figure 1C:
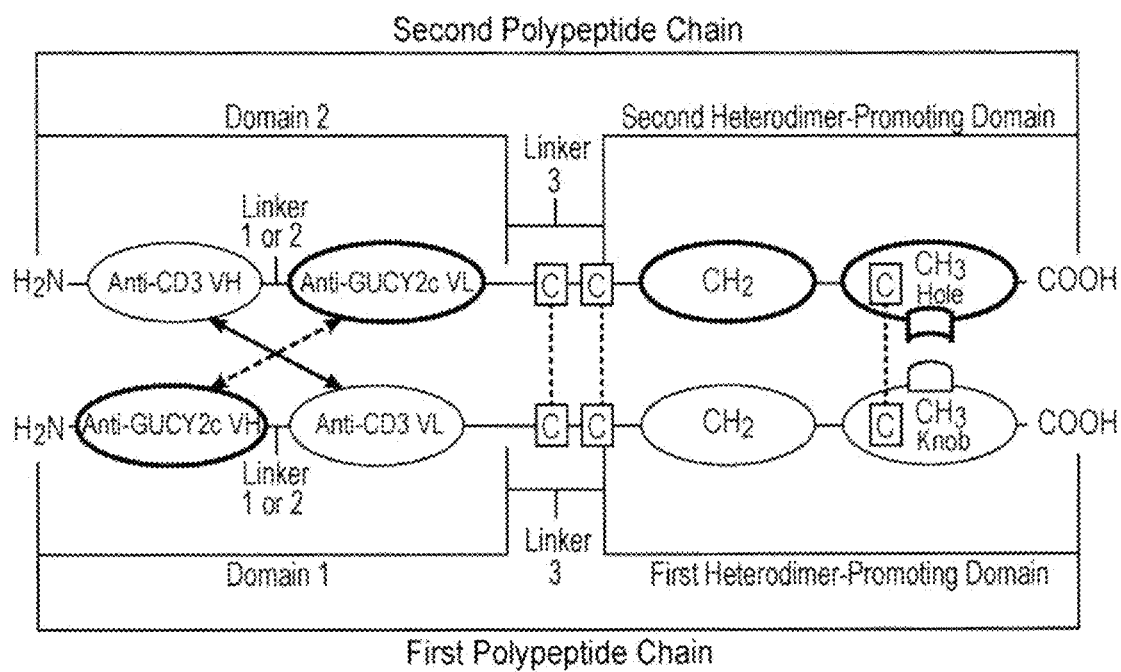
Figure 1D:
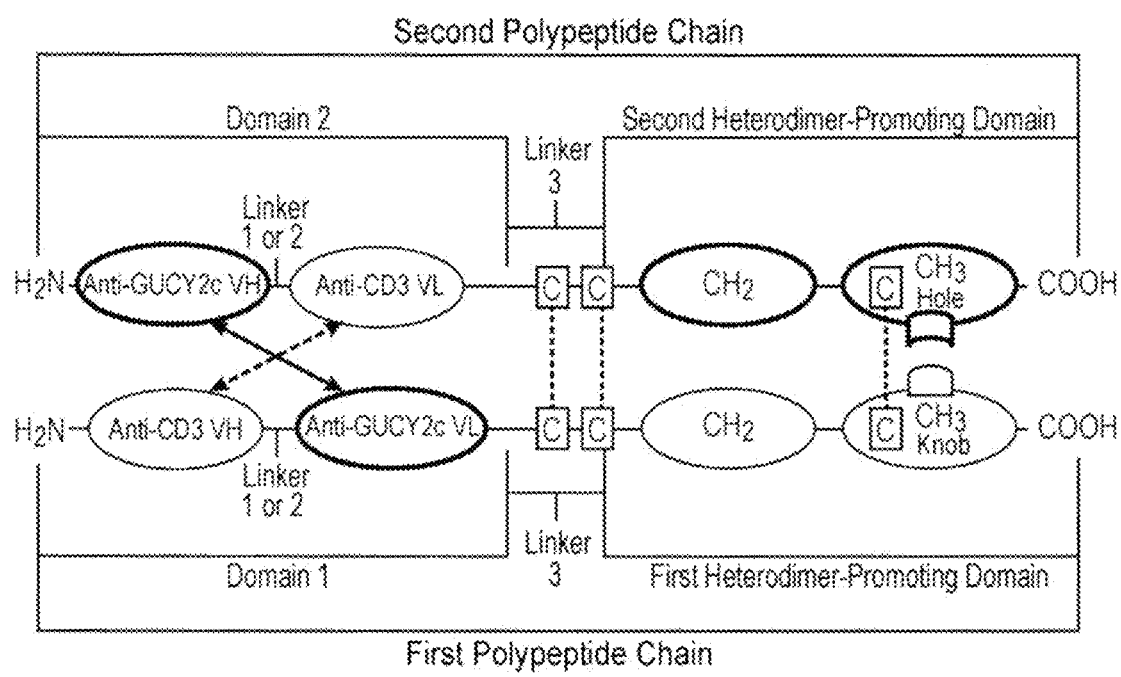
Figure 2A:
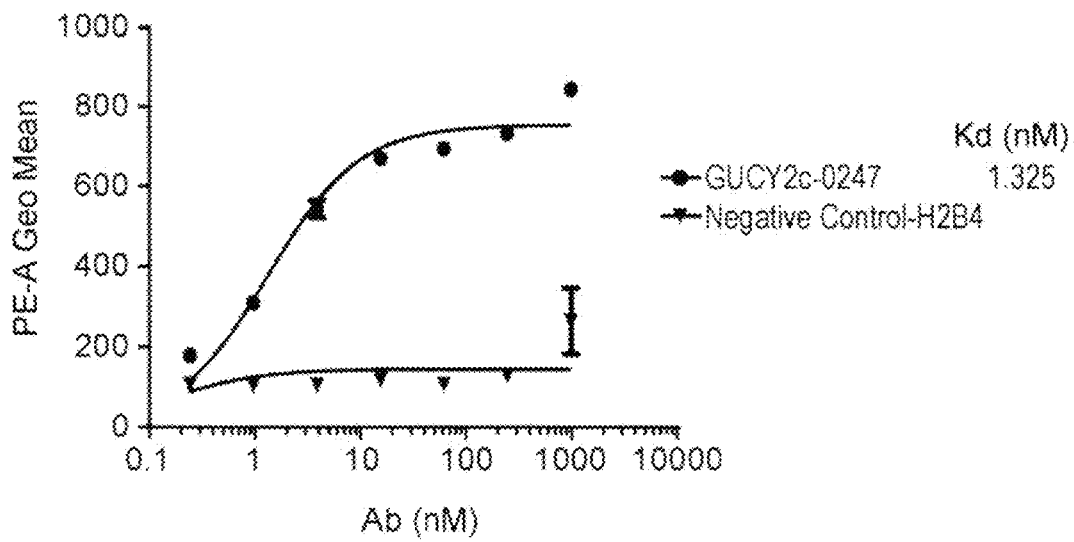
FIG. 2 depicts binding of (FIG. 2A) GUCY2C-0247, and (FIG. 2B) GUCY2C-1608 bispecific antibodies to T84 tumor cells using flow cytometry based assay.
Figure 2B:
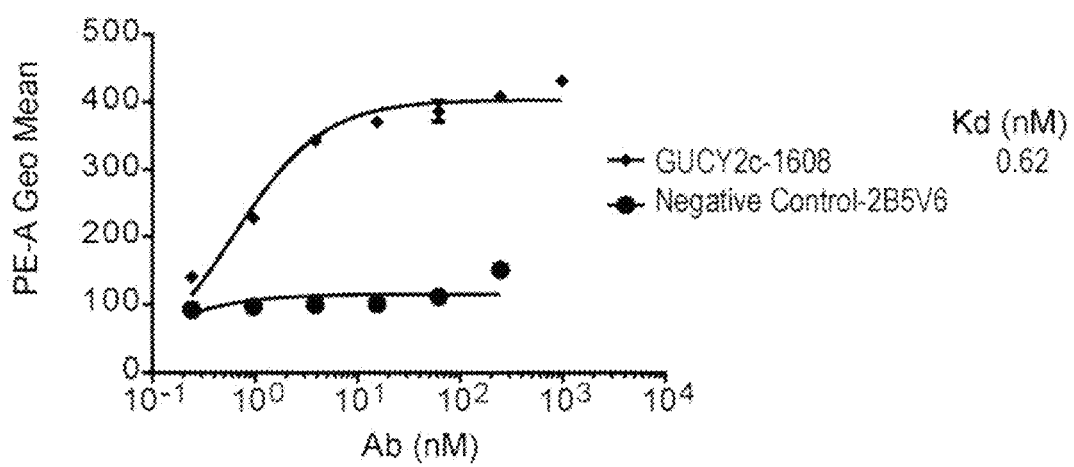
Figure 3A:
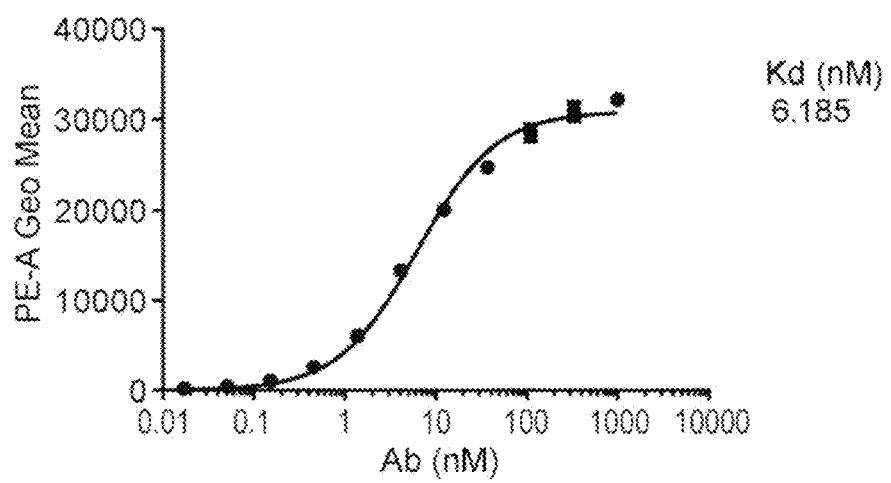
FIG. 3 depicts flow cytometry based assay to determine binding of (FIG. 3A) GUCY2C-0247, and (FIG. 3B) GUCY2C-1608 bispecific antibodies to naïve human T cells.
Figure 3B:
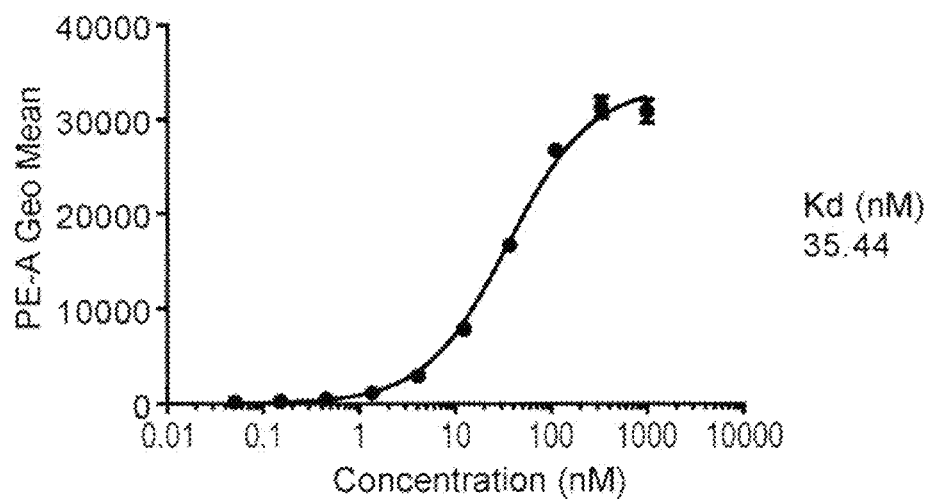

Optimized CD3 bispecific antibodies were titrated for cell surface binding to GUCY2c on T84 cells and to human CD3 on naïve human T cells purified from fresh human peripheral blood mononuclear cells (PBMCs), using the flow cytometry methods previously described. Humanized and optimized GUCY2c clones GUCY2C-0247 and GUCY2C-1608 demonstrated low/sub nM binding affinity to T84 cells expressing human GUCY2c (FIGS. 2A and 2B). Humanized and optimized GUCY2c bispecific antibodies were also assessed for CD3 cell surface binding by flow cytometry (FIGS. 3A and 3B), and showed low-mid nM binding affinity to naïve human T cells.

Example 15

Immunogenicity De-risking of GUCY2c Bispecific Antibodies

When some therapeutic proteins are administered to patients, unwanted immune responses, such as generation of anti-drug antibody (ADA), have impacted drug efficacy and caused patient safety problems (Yin L., et al., Cell Immunol. June; 295(2):118-26, 2015). ADAs can be classified into two groups: neutralizing ADA (NAb) or non-neutralizing ADA (non-NAb) depending on whether they inhibit the therapeutic protein's pharmacological activity (Yin L., et al., Cell Immunol. June; 295(2):118-26, 2015). There are two possible mechanisms through which NAb and non-NAb could contribute to reduced drug efficacy. First, NAb directly blocks the binding of the therapeutic protein to its targeting molecule, therefore reducing its therapeutic efficacy (Yin L., et al., Cell Immunol. June; 295(2):118-26, 2015). Second, NAb and non-NAb could contribute to increased clearance affecting the pharmacokinetics (PK) of TPP therefore compromising drug efficacy (Yin L., et al., Cell Immunol. June; 295(2):118-26, 2015). Immunogenicity against a therapeutic protein can be generated in both T cell-dependent and T cell-independent pathways. In the T cell-dependent pathway, T cells are activated through the recognition of therapeutic protein-derived antigenic peptides presented by major histocompatibility complex class II molecules (MHC II) in antigen-presenting cells. The activated T cells then stimulate B cells to generate therapeutic protein-specific ADA (Yin L., et al., Cell Immunol. June; 295(2):118-26, 2015). To minimize the potential for immunogenicity arising through T cell-dependent responses, efforts were made to reduce the antigenic potential of the CD3-GUCY2c bispecific antibody sequences using in silico methods described below.

Sequences were analyzed using two protocols (detailed below) to identify potential T cell epitopes. Any sequence flagged by the rules described herein for either protocol was considered an epitope. The current specification examines sequences primarily at the level of amino acid 9-mers.

Method 1: Sequences were submitted for EpiMatrix analysis in the ISPRI software package (ISPRI v 1.8.0, EpiVax Inc., Providence, R.I. (2017); Schafer J R A, Jesdale B M, George J A, Kouttab N M, De Groot A S. Prediction of well-conserved HIV-1 ligands using a matrix-based algorithm, EpiMatrix. Vaccine 16(19), 1880-84, 1998). The raw results provide rankings of likelihood of binding of each 9-mer amino acid fragment against 8 different HLA types. Thus, there are 8 predictions ("observations") for each 9-mer. The 9-mers are generated starting at each individual linear numbering position of the sequence (thus, it is possible for the same 9-mer to occur more than once in the same sequence). If any 4 observations indicate that the 9-mer is in the top 5% of binders (meaning it is predicted to be in the top 5% of binders for at least 4 HLA types), the 9-mer is considered a predicted epitope ("epitope"). Alternatively, if any 1 of the 8 predictions indicate that the 9-mer is in the top 1% of binders, the 9-mer is also considered a predicted epitope.

Method 2: Sequences were submitted for analysis using the MHC-II binding Consensus method (Wang P, Sidney J, Kim Y, Sette A, Lund O, Nielsen M, Peters B. Peptide binding predictions for HLA DR, DP and DQ molecules. BMC Bioinformatics 11:568, 2010; Wang P, Sidney J, Dow C, Mothé B, Sette A, Peters B. A systematic assessment of MHC class II peptide binding predictions and evaluation of a consensus approach. PLoS Comput Biol. 4(4), e1000048, 2008 in IEDB (Vita R, Overton J A, Greenbaum J A, Ponomarenko J, Clark J D, Cantrell J R, Wheeler D K, Gabbard J L, Hix D, Sette A, Peters B. The immune epitope database (IEDB) 3.0. Nucleic Acids Res. January 28 (43), D405-12, 2015; IEDB MHC-II Binding Predictions, http://www.iedb.org)

The output of the software arranges results by 15-mer. A consensus score and percentile ranking is provided for each combination of 15-mer and HLA type. But the individual scores from which each 15-men's consensus is derived are rankings of certain 9-mers found in the 15-mer: each method used for the consensus reports a percentile rank for a 9-mer within the 15-mer, and the consensus taken as the value for the overall 15-mer is the prediction for the 9-mer having the median score. We classify a 9-mer as an epitope if (a) it is chosen as the consensus representative for the 15-mer AND (b) has a percentile ranking in the top 10% of binders for the HLA type being considered, AND if criteria (a) and (b) occur for three or more distinct HLA types for the same 9-mer (i.e., three observations). The HLA types considered were DRB1*01, 1*03, 1*04, 1*07, 1*08, 1*11, 1*13, and 1*15, which are the same HLA types in a standard ISPRI/EpiMatrix report. Thus, although the primary output of the method is a ranking of 15-mers, we reinterpret the data to obtain a list of predicted 9-mer epitopes, for ease of comparison with Method 1.

We classified each epitope as a germline or non-germline epitope. For antibodies, we further classify each epitope based on its location within the antibody (CDR or non-CDR). We filtered sequences of human V domains obtained from IMGT (www.imgt.org) to remove germlines annotated as pseudogenes or open reading frames (ORFs). Any predicted 9-mer epitope found in the remaining sequences was considered a germline epitope. Epitopes found in the J or C regions (including IgG1, IgG2, IgG3, and IgG4) or the junctions between these regions were also classified as germline epitopes. Otherwise, an epitope is classified as a non-germline epitope. CDR definitions were based on the numbering system of Kabat (Kabat E A, Wu T T, Perry H M, Gottesman K S, Foeller C. Sequences of Proteins of Immunological Interest, US Department of Health and Human Services, NIH Publication No. 91-3242, 1991), where the CDRs are defined to include the following residues: VH CDR1 (H26-H35 including insertions such as H35A, up to but not including H36), VH CDR2 (H50-H65 inclusive), VH CDR3 (H95-H102 inclusive) VL CDR1 (L24-L34 inclusive), VL CDR2 (L54-L56 inclusive), VL CDR3 (L89-L97, inclusive). A predicted 9-mer epitope is a CDR epitope if any one of its amino acids is part of a CDR region. Note that our chosen start position (H26) for VH CDR1 differs from some other publications using Kabat annotation.

For an individual chain, or for a pairing of an antibody VH and VL domain, an overall score can be calculated by summing over each of the constituent 9-mers as follows. All individual combinations of 9-mer and HLA type ("observations") are examined, regardless of whether the 9-mer is an epitope. If a particular observation indicates the peptide is in the top 5% of binders for the given HLA type, the EpiMatrix Z-score for this observation is added to a running total associated with the entire protein sequence. The total number of observations examined is also recorded. The only exception is that all observations on 9-mers identified by ISPRI as "T-regitopes" are assumed to have EpiMatrix scores of zero. In the running total, a baseline score of 0.05*2.2248 is subtracted from each observation (including T-regitopes). The final score is computed as follows:

$$T\text{-reg Adjusted Score} = (\text{Running total})*1000/(\text{Number of observations})$$

Lower scores indicate lower predicted immunogenic potential.

The score only includes predictions from ISPRI/EpiMatrix, and does not include information from IEDB. Therefore, any strong HLA binders predicted by IEDB but not ISPRI do not contribute to the score. In theory, sequences may contain many IEDB-predicted HLA binders and still have a favorable T-reg Adjusted Score if EpiMatrix does not also predict the same sequences to be likely binders.

Alignment of non-optimized and optimized GUCY2c VH and VL regions with germlines. Residues in bold represent T cell epitope hot spots as determined using the in silico methods above. In certain embodiments, the substitution is human germline substitution in which a CDR residue is replaced with the corresponding human germline residue, to increase the human amino acid content and reduce potential immunogenicity of the antibody (as described previously). In other embodiments, the substitution is another amino acid that reduces the potential for immunogenicity of the antibody, and which does not disrupt the binding properties of the antibody.

For example, if human germline VH3-7 framework is used with exemplary antibodies GUCY2C-0241, then the alignment of the VH CDR2 of GUCY2C-0241 (SEQ ID NO: 28) and human germline VH3-7 (SEQ ID NO: 178) is as follows in Table 29 below (using the Kabat numbering system):

TABLE 29

| Clone | 50 | 51 | 52 | 52A | 53 | 54 | 55 | 56 | 57 | 58 | 59 | 60 | 61 | 62 | 63 | 64 | 65 |
|---|---|---|---|---|---|---|---|---|---|---|---|---|---|---|---|---|---|
| VH3-7 | N | I | K | Q | D | G | S | E | K | Y | Y | V | D | S | V | K | G |
| GUGY2c-0241 | E | I | K | P | S | N | G | L | T | N | Y | I | E | K | F | K | N |

For positions 51, 52, 59 and 64 the human germline residue and the corresponding GUCY2C-0241 residue are the same, and a germline substitution is not possible. For positions 50, 52A, 53, 54, 55, 56, 57, 58, 60, 61, 62, 63, and 65 (bold), the human germline residue and the corresponding GUCY2C-0241 residue are different. When the in silico T cell epitope assessment is run on the GUCY2C-0241 sequence, potential peptide sequences are identified (underlined). These are then further analyzed for non-human germline content and residues with both a T cell epitope score of >10 and being non-human germline are targeted for mutagenesis (show above in bold and underlined). Using soft randomization mutagenesis (methods previously described in U.S. Pat. No. 9,884,921) these residues were mutated and tested for retained binding activity and retained stability.

Example 16

T Cell Mediated Cell Killing Activity of Optimized CD3-GUCY2c Bispecific Antibodies Optimized CD3-GUCY2c bispecific antibodies were evaluated for T cell mediated cytotoxicity of tumor cells as described previously. Optimized GUCY2c bispecific antibodies demonstrated improved T cell efficient T cell mediated killing of T84 tumor cells. The results of cell killing assays with humanized CD3-GUCY2c bispecific antibody (E:T ratio=5:1) are shown in Table 30 and FIGS. 4A to 4D.

TABLE 30

| Clone | T84 tumor cell $EC_{50}$ (nM) |
|---|---|
| GUCY2C-0240 | 0.53 |
| GUCY2C-0453 | 17.65 |
| GUCY2C-0454 | 14.34 |
| GUCY2C-0247 | 0.07 |
| GUCY2C-0381 | 2.7 |
| GUCY2C-1186 | 0.22 |
| GUCY2C-1467 | 0.2 |
| GUCY2C-1476 | 0.07 |
| GUCY2C-1478 | 0.24 |
| GUCY2C-1481 | 1.57 |
| GUCY2C-1512 | 0.57 |
| GUCY2C-1518 | 0.37 |
| GUCY2C-1526 | 0.13 |
| GUCY2C-1538 | 0.05 |
| GUCY2C-1554 | 12.6 |
| GUCY2C-1555 | 1.13 |
| GUCY2C-1556 | 5.04 |
| GUCY2C-1557 | 0.22 |
| GUCY2C-1590 | 11.07 |
| GUCY2C-1592 | 2.6 |
| GUCY2C-1608 | 0.19 |

Example 17

Differential Scanning Calorimetry (DSC) Analysis

Proteins were diluted in a phosphate-buffered saline (PBS) solution to 0.6 mg/ml in a volume of 400 µl. PBS was used as a buffer blank in the reference cell. PBS contained 137 mM NaCl, 2.7 mM KCl, 8.1 mM Na2HPO4, and 1.47 mM KH2PO4, pH 7.2. Samples were dispensed into the sample tray of a MicroCal VP-Capillary DSC with Autosampler (Malvern Instruments Ltd, Malvern, UK). Samples were equilibrated for 5 minutes at 10° C. and then scanned up to 110° C. at a rate of 100° C. per hour. A filtering period of 16 seconds was selected. Raw data was baseline corrected and the protein concentration was normalized. Origin Software 7.0 (OriginLab Corporation, Northampton, Mass.) was used to fit the data to an MN2-State Model with an appropriate number of transitions. The results of differential scanning calorimetry of optimized anti-GUCY2c binding domains in scFv-Fc format are shown in Table 31. Optimized clones show improved temperature of unfolding (Tm1) compared to the parental, non-optimized clone GUCY2C-0247 (here as GUCY2C-0295 in scFv-Fc format).

TABLE 31

| Clone | DSC Tm1 | DSC Tm2 | DSC Tm3 |
|---|---|---|---|
| GUCY2C-0295 | 57.9 | 68.8 | 83.6 |
| GUCY2C-0389 | 64.2 | 67.5 | 83.6 |
| GUCY2C-0393 | 64.1 | 67.5 | 83.6 |
| GUCY2C-0401 | 69.1 | 69.1 | 83.6 |
| GUCY2C-0403 | 73.3 | 73.3 | 84.5 |
| GUCY2C-0411 | 69.1 | 69.1 | 83.8 |
| GUCY2C-0413 | 71.6 | 76.2 | 84.5 |
| GUCY2C-0418 | 51 | 68.1 | 83.7 |
| GUCY2C-0421 | 71.5 | 71.5 | 84 |
| GUCY2C-0423 | 66.1 | 66.1 | 83.8 |
| GUCY2C-0425 | 71.6 | 71.6 | 84 |
| GUCY2C-0427 | 68.3 | 72.1 | 84 |
| GUCY2C-0428 | 71.2 | 71.2 | 84.1 |
| GUCY2C-0435 | 65.3 | 65.3 | 83.7 |
| GUCY2C-0439 | 72.8 | 72.8 | 84.4 |
| GUCY2C-0445 | 67 | 67 | 83.8 |
| GUCY2C-0447 | 69.7 | 69.7 | 84.3 |
| GUCY2C-0448 | 71.6 | 71.6 | 84.3 |
| GUCY2C-0450 | 71.2 | 71.2 | 84.2 |
| GUCY2C-0451 | 71.6 | 71.6 | 84.2 |

Example 18

Surface Plasmon Resonance (SPR) Analysis of CD3-GUCY2c Bispecific Antibodies

The binding affinities of CD3-GUCY2c bispecific antibodies to human GUCY2c (SEQ ID NO: 224), cyno GUCY2c (SEQ ID NO: 236) and murine GUCY2C (SEQ ID NO: 240) were determined using a BIACORE™ T200 instrument (GE Healthcare) at 25° C. and 37° C. with a collection rate of 10 Hz. Human GUCY2c, cyno GUCY2c and mouse GUCY2c were directly immobilized onto three different flow cells of a CM5 Sensor Chip (BR100530, GE Healthcare) surface using an amine coupling kit (BR100050, GE Healthcare) according to the manufacturer's protocol. The final immobilization levels of human, cyno and murine GUCY2c were 142 resonance units (RU), 61 RU and 201 RU respectively. Flow cell 1 was used as a reference flow cell. A three-fold dilution series of CD3-GUCY2c bispecifc antibodies with concentrations ranging from 450 nM to 5.56 nM was injected over the sensor surface for 52 seconds at a flow rate of 50 µl/min. The dissociation was monitored for 400 seconds and the surface was regenerated with 10 mM Glycine pH 2.1. The running and sample buffer was 10 mM HEPES pH 7.4, 0.15 M NaCl, 3 mM EDTA, 0.05% P-20 (HBS-EP+). The data were double referenced. Binding affinities and rate constants were determined by fitting the resulting sensorgram data to a 1:1 Langmuir model in BIACORE™ T200 Evaluation software version 3.0 (GE Healthcare). The binding affinities of GUCY2c bispecific antibodies to human CD3 (SEQ ID NO: 242) and cyno CD3 (SEQ ID NO: 244) were determined using a BIACORE™ T200 instrument (GE Healthcare) at 25° C. and 37° C. with a collection rate of 10 Hz. Human CD3 and cyno were captured onto three different flow cells of a CM5 Sensor Chip (BR100050, GE Healthcare) surface using the His Capture Kit (28995056, GE Healthcare) according to the manufacturer's protocol. The capture levels of human CD3 (SEQ ID NO: 242) were 8 resonance units (RU) and 16 RU on flow cells 2 and 3 respectively with 10 RUs of Cyno CD3 was captured on flow cell 4. Flow cell 1 was used as a reference. A three-fold dilution series of GUCy2c bispecific protein with concentrations ranging from 100 nM to 3.7 nM was injected over the sensor surface for 55 seconds at a flow rate of 50 µl/min. The dissociation was monitored for 300 seconds and the surface was regenerated with 10 mM Glycine pH 1.5. The running and sample buffer was 10 mM HEPES pH 7.4, 0.15 M NaCl, 3 mM EDTA, 0.05% P-20 (HBS-EP+). The data were double referenced. Binding affinities and rate constants were determined by fitting the resulting sensorgram data to a 1:1 Langmuir model in BIACORE™ T200 Evaluation software version 3.0 (GE Healthcare). The results of BIACORE™ binding analysis of CD3-GUCY2c bispecific antibodies to human, cyno and mouse GUCY2c under different conditions including assay orientation and temperature are shown in Tables 32A to 32J. Humanized and optimized GUCY2C binding domains show retained or improved binding to GUCY2C and CD3 as bispecific antibodies. In some instances elevated temperature (37C) a decrease in binding affinity was observed.

Table 32A shows binding Kinetics of CD3-GUCY2c bispecific antibodies to human GUCY2c. The capture method used was anti-human IgG capture at 25° C.

TABLE 32A

| Clone | ka (1/Ms) | kd (1/s) | $K_D$ (nM) | N |
|---|---|---|---|---|
| GUCY2C-0074 | 4.41E+4 ± 2.17E+3 | 2.00E-3 ± 4.27E-5 | 45.40 ± 2.90 | 4 |
| GUCY2C-0098 | 1.36E+5 ± 4.79E+1 | 6.75E-4 ± 1.97E-6 | 4.96 ± 0.02 | 2 |
| GUCY2C-0240 | 9.62E+4 ± 4.76E+3 | 3.64E-3 ± 1.22E-5 | 37.90 ± 1.75 | 2 |
| GUCY2C-0247 | 9.82E+4 ± 1.64E+3 | 4.57E-4 ± 2.84E-6 | 4.65 ± 0.09 | 4 |
| GUCY2C-1478 | 1.18E+5 ± 7.24E+2 | 4.34E-4 ± 3.05E-5 | 3.69 ± 0.28 | 2 |

Table 32B shows binding Kinetics of CD3-GUCY2c bispecific antibodies to human GUCY2c. The capture method used was Direct Immobilization at 25° C.

TABLE 32B

| Clone | ka (1/Ms) | kd (1/s) | $K_D$ (nM) | N |
|---|---|---|---|---|
| GUCY2C-0077 | 1.43E+5 ± 1.7E+4 | 2.24E-2 ± 1.00E-3 | 160.00 ± 25.00 | 2 |
| GUCY2C-0098 | 1.45E+5 ± 2.41E+3 | 1.04E-3 ± 2.61E-5 | 7.19 ± 0.30 | 2 |
| GUCY2C-0104 | 1.48E+5 ± 1.00E+4 | 3.86E-3 ± 2.00E-5 | 26.10 ± 1.90 | 2 |
| GUCY2C-0240 | 9.62E+4 ± 4.76E+3 | 3.64E-3 ± 1.22E-5 | 37.90 ± 1.75 | 2 |
| GUCY2C-0247 | 1.44E+5 ± 1.83E+3 | 4.33E-4 ± 2.88E-6 | 3.01 ± 0.02 | 2 |
| GUCY2C-1608 | 1.01E+5 ± 2.19E+3 | 7.58E-4 ± 1.68E-6 | 7.47 ± 0.15 | 2 |

Table 32C shows binding Kinetics of CD3-GUCY2c bispecific antibodies to human GUCY2c. The capture method used was Direct Immobilization at 37° C.

TABLE 32C

| Clone | ka (1/Ms) | kd (1/s) | $K_D$ (nM) | N |
|---|---|---|---|---|
| GUCY2C-0098 | 2.51E+5 ± 4.65E+3 | 3.77E-3 ± 1.85E-5 | 15.02 ± 0.35 | 2 |
| GUCY2C-1608 | 1.61E+5 ± 8.47E+3 | 2.17E-3 ± 6.58E-5 | 13.52 ± 1.12 | 2 |

Table 32D shows binding Kinetics of CD3-GUCY2c bispecific antibodies to cyno GUCY2c. The capture method used was anti-human IgG capture at 25° C.

TABLE 32D

| Clone | ka (1/Ms) | kd (1/s) | $K_D$ (nM) | N |
|---|---|---|---|---|
| GUCY2C-0074 | 4.73E+4 ± 7.70E+3 | 2.84E-3 ± 3.60E-4 | 60.35 ± 2.15 | 2 |
| GUCY2C-0098 | 1.34E+5 ± 1.63E+3 | 5.24E-4 ± 3.93E-5 | 3.93 ± 0.34 | 2 |
| GUCY2C-0240 | 2.61E+4 ± 7.10E+3 | 2.34E-3 ± 5.24E-4 | 91.20 ± 12.50 | 4 |
| GUCY2C-0247 | 8.55E+4 ± 1.35E+4 | 3.69E-4 ± 4.35E-5 | 4.35 ± 0.24 | 4 |

Table 32E shows binding Kinetics of CD3-GUCY2c bispecific antibodies to cyno GUCY2c. The capture method used was Direct Immobilization at 25° C.

TABLE 32E

| Clone | ka (1/Ms) | kd (1/s) | $K_D$ (nM) | N |
|---|---|---|---|---|
| GUCY2C-0098 | 2.06E+5 ± 1.17E+3 | 5.77E-4 ± 3.50E-6 | 2.80 ± 0.03 | 2 |
| GUCY2C-1608 | 1.38E+5 ± 1.04E+3 | 4.17E-4 ± 7.61E-6 | 3.01 ± 0.03 | 2 |

Table 32F shows binding Kinetics of CD3-GUCY2c bispecific antibodies to cyno GUCY2c. The capture method used was Direct Immobilization at 37° C.

TABLE 32F

| Clone | ka (1/Ms) | kd (1/s) | $K_D$ (nM) | N |
|---|---|---|---|---|
| GUCY2C-0098 | 3.10E+5 ± 7.75E+3 | 2.64E-3 ± 3.76E-5 | 8.52 ± 0.33 | 2 |
| GUCY2C-1608 | 1.91E+5 ± 1.18E+4 | 1.66E-3 ± 4.67E-5 | 8.68 ± 0.29 | 2 |

Table 32H shows binding Kinetics of CD3-GUCY2c bispecific antibodies to murine GUCY2c. The capture method used was anti-human IgG capture at 25° C.

TABLE 32H

| Clone | ka (1/Ms) | kd (1/s) | $K_D$ (nM) | N |
|---|---|---|---|---|
| GUCY2C-0074 | 1.48E+4 ± 5.32E+1 | 2.82E-3 ± 1.08E-4 | 191.01 ± 6.60 | 2 |
| GUCY2C-0098 | 3.75E+4 ± 1.31E+3 | 4.02E-3 ± 2.25E-5 | 107.19 ± 3.15 | 2 |
| GUCY2C-0240 | 1.06E+4 ± 8.30E+1 | 3.36E-3 ± 6.89E-5 | 316.54 ± 8.95 | 2 |

Table 32I shows binding Kinetics of CD3-GUCY2c bispecific antibodies to murine GUCY2c. The capture method used was Direct Immobilization at 25° C.

TABLE 32I

| Clone | ka (1/Ms) | kd (1/s) | $K_D$ (nM) | N |
|---|---|---|---|---|
| GUCY2C-0098 | 1.34E+5 ± 1.61E+3 | 2.68E−3 ± 1.55E−5 | 19.97 ± 0.36 | 2 |
| GUCY2C-0240 | 1.22E+5 ± 3.83E+3 | 5.15E−3 ± 1.35E−5 | 42.34 ± 1.44 | 2 |
| GUCY2C-0247 | 1.50E+5 ± 1.67E+3 | 1.83E−3 ± 9.99E−6 | 12.22 ± 0.07 | 2 |
| GUCY2C-1608 | 9.12E+4 ± 1.13E+3 | 1.57E−3 ± 3.04E−6 | 17.27 ± 0.25 | 2 |

Table 32J shows binding Kinetics of CD3-GUCY2c bispecific antibodies to murine GUCY2c. The capture method used was Direct Immobilization at 37° C.

TABLE 32J

| Clone | ka (1/Ms) | kd (1/s) | $K_D$ (nM) | N |
|---|---|---|---|---|
| GUCY2C-0098 | 1.96E+5 ± 1.25E+4 | 2.01E−2 ± 1.48E−3 | 102.66 ± 0.97 | 2 |
| GUCY2C-1608 | 1.29E+5 ± 7.10E+3 | 1.16E−2 ± 1.61E−4 | 90.17 ± 3.71 | 2 |

Tables 33A to 33F show BIACORE™ binding analysis of CD3-GUCY2c bispecific antibodies to human, and cyno CD3 under different conditions including assay orientation and temperature.

Table 33A shows binding Kinetics of CD3-GUCY2c bispecific antibodies to human CD3 protein. The capture method used was anti-human IgG capture at 25° C.

TABLE 33A

| Clone | ka (1/Ms) | kd (1/s) | $K_D$ (nM) | N |
|---|---|---|---|---|
| GUCY2C-0074 | 4.71E+5 ± 2.16E+5 | 8.61E−4 ± 1.56E−5 | 2.17 ± 0.99 | 4 |
| GUCY2C-0098 | 2.97E+5 ± 1.28E+3 | 9.67E−4 ± 2.15E−5 | 3.26 ± 0.09 | 2 |
| GUCY2C-0240 | 3.47E+5 ± 8.83E+3 | 1.29E−3 ± 4.5E−5 | 3.73 ± 0.19 | 4 |
| GUCY2C-0247 | 2.95E+5 ± 2.17E+3 | 9.85E−4 ± 6.34E−6 | 3.34 ± 0.04 | 4 |

Table 33B shows binding Kinetics of CD3-GUCY2c bispecific antibodies to human CD3. The capture method used was anti-His at 25° C.

TABLE 33B

| Clone | ka (1/Ms) | kd (1/s) | $K_D$ (nM) | N |
|---|---|---|---|---|
| GUCY2C-0098 | 1.10E+6 ± 2.14E+4 | 5.24E−3 ± 8.88E−5 | 4.75 ± 0.08 | 4 |
| GUCY2C-1478 | 3.55E+5 ± 6.10E+3 | 9.56E−3 ± 1.37E−4 | 26.93 ± 0.76 | 3 |
| GUCY2C-1608 | 4.18E+5 ± 2.78E+4 | 9.99E−3 ± 2.41E−4 | 23.97 ± 0.97 | 4 |

Table 33C shows binding Kinetics of CD3-GUCY2c bispecific antibodies to human CD3. The capture method used was anti-His at 25° C.

TABLE 33C

| Clone | ka (1/Ms) | kd (1/s) | $K_D$ (nM) | N |
|---|---|---|---|---|
| GUCY2C-0098 | 2.51E+6 ± 6.34E+5 | 5.05E−2 ± 1.43E−2 | 19.93 ± 0.72 | 4 |
| GUCY2C-1608 | 7.44E+5 ± 2.31E+5 | 9.00E−2 ± 2.18E−2 | 123.77 ± 10.95 | 4 |

Table 33D shows binding Kinetics of CD3-GUCY2c bispecific antibodies to cyno CD3. The capture method used was anti-His at 25° C.

TABLE 33D

| Clone | ka (1/Ms) | kd (1/s) | $K_D$ (nM) | N |
|---|---|---|---|---|
| GUCY2C-0074 | 4.25E+5 ± 1.36E+4 | 1.12E−3 ± 8.98E−5 | 2.64 ± 0.28 | 4 |
| GUCY2C-0098 | 2.84E+5 ± 9.80E+3 | 1.01E−3 ± 3.55E−5 | 3.56 ± 0.25 | 2 |
| GUCY2C-0240 | 4.40E+5 ± 5.00E+2 | 2.07E−3 ± 8.00E−5 | 4.71 ± 0.19 | 2 |
| GUCY2C-0247 | 2.80E+5 ± 1.48E+4 | 1.00E−3 ± 6.76E−5 | 3.61 ± 0.43 | 4 |

Table 33E shows binding Kinetics of CD3-GUCY2c bispecific antibodies to cyno CD3. The capture method used was anti-His at 25° C.

TABLE 33E

| Clone | ka (1/Ms) | kd (1/s) | $K_D$ (nM) | N |
|---|---|---|---|---|
| GUCY2C-0098 | 9.69E+5 ± 1.85E+4 | 4.78E−3 ± 1.03E−4 | 4.94 ± 0.01 | 2 |
| GUCY2C-1608 | 3.81E+5 ± 2.33E+4 | 9.16E−3 ± 2.31E−4 | 24.12 ± 0.87 | 2 |

Table 33F shows binding Kinetics of CD3-GUCY2c bispecific antibodies to cyno CD3. The capture method used was anti-His at 25° C.

TABLE 33F

| Clone | ka (1/Ms) | kd (1/s) | $K_D$ (nM) | N |
|---|---|---|---|---|
| GUCY2C-0098 | 2.28E+6 ± 3.59E+5 | 4.42E−2 ± 7.86E−3 | 19.34 ± 0.40 | 2 |
| GUCY2C-1608 | 5.14E+5 ± 1.86E+4 | 6.65E−2 ± 1.46E−3 | 129.78 ± 7.53 | 2 |

Example 19

In Vitro Cytokine Release Measurements of CD3-GUCY2c Bispecific Antibodies

T84 cells were treated with T cells (E:T ratio of 5:1) and GUCY2C-1608 at different doses. Supernatants were collected at different time points (24 h, 48 h, 96 h) and analyzed using a multiplex Lumninex assay according to the manufacturer's guidelines and read on a Luminex 200 with xPONENT software. The cytokines measured were human IFN-gamma, IL10, IL2, IL4, IL6, TNF-alpha. FIGS. 5A-5F illustrate cytokine release profiles for GUCY2C-1608. These cytokines were upregulated with GUCY2C-1608 treatment of T84 cells in the presence of T cells, supporting a mechanism of T-cell mediated CD3-GUCY2c bispecific antibody activity in GUCY2c expressing cells.

Example 20

In Vivo Evaluation of CD3-GUCY2c Bispecific Antibody Mediated Activity

Human PBMCs were thawed into media (X-VIVO 15 (Lonza). 5% human serum albumin (Gemini #100-318), 1% Penn/Strep, 0.01 mM 2-mercaptoethanol) at approximately 5 million cells per ml. Cells were spun down and resuspended in Robosep buffer (Stem Cell Technologies) at a concentration of 50 million cells per ml. T cells were isolated using the EasySep human T cell enrichment kit (Stem cell technologies. T cells were activated and expanded using a Human T cell activation/Expansion kit (Miltenyi). On day 2, T cells were transferred to a G-Rex cell culture device for expansion, and IL-2 (Stem Cell Technologies) was added to the media and replenished after 2 days. T cells were harvested 1 week after activation/expansion. At the time of harvest, beads were removed with a magnet, and cells were resuspended in DPBS at $1\times10^7$ cells/mL for in vivo inoculation.

For xenograft studies, NSG mice were inoculated with either colorectal tumor cell lines (T84, H55, LS1034) or patient derived xenograft (PDX-CRX-11201, PDX-CRX-12213, PDX-CRX-24225) fragments subcutaneously in the flank.

Tumor measurements were collected using a digital Vernier caliper, and volumes were calculated by use of the modified ellipsoid formula ½×length×width2. Mice were randomized and staged at tumor size of 150-200 mm$^3$. An initial dose of GUCY2c bispecific, negative control bispecific, or vehicle was administered to animals on day 0, and 2 million cultured T-cells were inoculated the following day. Mice were dosed in 0.2 mL bolus injection weekly up to 5 times, and all compound and T-cell administrations were intravenous via the lateral tail vein of each animal. Tumor measurements were collected twice weekly along with continuous monitoring for signs of a graft versus host response (FIGS. 6-15). All CD3-GUCY2c bispecific antibodies showed dose dependent T-cell mediated anti-tumor activity in both cell line xenograft and patient derived xenograft models.

Example 21

Cyclic Guanosine Monophosphate (cGMP) Assay to Characterize GUCY2c-CD3 Bispecific for Potential GUCY2c Pathway Modulation Activity To test cyclic Guanosine monophosphate (cGMP) production by T84 cells in response to GUCY2c pathway stimulation, $2\times10^6$ T84 cells were plated in a 24 well plate overnight. Cell were washed with DMEM containing 50 mM HEPES and treated with DMEM containing 50 mM HEPES and 1 mM 3-isobutyl-1-methylxanthine (IBMX) for 15 minutes. Cells were then treated with GUCY2C-1608 or a negative control bispecific at concentrations ranging from 0.1 to 99 µM. As a positive control, GUCY2c agonist, enterotoxin STp (BACHEM) was added (0.02 to 51 µM) for 45 minutes. Particulates were removed by centrifugation and 200 µl of the supernatant was used to assay for cGMP production using the cGMP Parameter Assay Kit (R&D Systems) according the manufacturer's guidelines. To assess potential neutralizing activity of GUCY2C-1608, 0.2 µM of STp was added to the same range of GUCY2C-1608 or negative control bispecific described above for 45 minutes, and supernatants were similarly analyzed for cGMP levels.

GUCY2c pathway activity was assessed in T84 cells by measuring cGMP production. While the GUCY2c pathway agonist bacterial enterotoxin STp increased cGMP in a dose-dependent manner, cGMP production was not enhanced by the addition of increasing concentrations of GUCY2C-1608. Additionally, GUCY2C-1608 did not affect cGMP production induced by 0.2 µM STp (FIG. 16). These findings indicate the GUCY2C-1608 is not a GUCY2c pathway agonist and does not neutralize GUCY2c pathway function in the presence of ligand.

Example 22

DNA and Insulin Polyspecificity ELISA

Nonspecific binding of antibodies to molecules other than their targets has been proposed to be a mechanism of rapid clearance in vivo (Hötzel et al., 2010, MAbs 4(6):753-760). Evidence for such polyreactive non-target binding can be obtained through measurement of binding to membrane preparations (Xu et al., Protein Eng. Des. Select. 26(10): 663-70, 2013), baculovirus particles (Hötzel et al., mAbs 4, 753-760, (2012), or negatively-charged substrates such as DNA, insulin, and heparin (Tiller et al., J. Immunol. Methods 329(1-2):112-124, 2008). The ELISA for DNA and insulin used a low-stringency protocol originally developed for detection of low-affinity autoantibodies from lupus patients (Tiller et al., J. Immunol. Methods 329, 112, 2008; U.S. Pat. No. 7,314,622).

384-well ELISA plates (Nunc Maxisorp) were coated overnight at 4° C. with DNA (10 µg/ml) and insulin (5 µg/ml) in PBS pH 7.5. The ELISA, adapted from assays described in Tiller et al., J. Immunol. Methods 329, 112, 2008; U.S. Pat. No. 7,314,622, was carried out on a PerkinElmer Janus liquid handling robot. Wells were washed with water, blocked with 50 µl of Polyreactivity ELISA Buffer (PEB; PBS containing 0.5% Tween-20, 1 mM EDTA) for 1 hour at room temperature, and rinsed three times with water. Serially-diluted mAbs in 25 µl were added in quadruplicate to the wells and incubated for 1 h at room temperature. Plates were washed 3 times with water, and 25 µl of 10 ng/ml goat anti-human IgG, (Fcγ fragment specific) conjugated to horseradish peroxidase (Jackson ImmunoResearch) were added to each well. Plates were incubated for 1 h at room temperature, washed 3 times with 80 µl of water, and 25 µl of TMB substrate (Sigma Aldrich) added to each well. Reactions were stopped after 6 minutes 50 seconds by adding 25 µl of 0.18M ortho-phosphoric acid to each well and absorbance read at 450 nm. DNA- and insulin-binding scores were calculated as the ratio of the ELISA signal of the antibody at 10 µg/ml to the signal of a well containing buffer. Table 34 shows the polyspecificy analysis of CD3-GUCY2c bispecific antibodies using the DNA and Insulin binding ELISA. Optimized bispecific antibodies show low potential for non-specific binding.

TABLE 34

| Clone | DNA Polyreactivity Score | Insulin Polyreactivity Score |
|---|---|---|
| GUCY2C-0405 | 3 | 1 |
| GUCY2C-0486 | 2 | 1 |
| GUCY2C-1186 | 13 | 7 |
| GUCY2C-1467 | 6 | 7 |
| GUCY2C-1476 | 7 | 7 |
| GUCY2C-1478 | 5 | 7 |
| GUCY2C-1481 | 4 | 5 |

TABLE 34-continued

| Clone | DNA Polyreactivity Score | Insulin Polyreactivity Score |
|---|---|---|
| GUCY2C-1518 | 6 | 3 |
| GUCY2C-1526 | 6 | 4 |
| GUCY2C-1538 | 13 | 7 |
| GUCY2C-1554 | 3 | 2 |
| GUCY2C-1555 | 4 | 2 |
| GUCY2C-1556 | 3 | 1 |
| GUCY2C-1557 | 5 | 3 |
| GUCY2C-1590 | 2 | 1 |
| GUCY2C-1591 | 3 | 2 |
| GUCY2C-1592 | 4 | 2 |
| GUCY2C-1606 | 2 | 1 |
| GUCY2C-1608 | 3 | 2 |

Example 23

Affinity Capture Self-Interaction Nanoparticle Spectroscopy (AC-SINS)

Antibody and antibody-like proteins have the potential to interact with themselves, particularly at increased concentrations. This self-interaction can lead to viscosity challenges associated with formulation during drug development as well as increased risk of clearance (Avery et al., mAbs, 2018, Vol. 0, NO. 0, 1-12). The affinity capture self-interaction nanoparticle spectroscopy assay measures self-interaction and is used to help predict high viscosity and the potential for poor pharmacokinetic properties.

The AC-SINS assay was standardized in a 384-well format on a Perkin-Elmer Janus liquid handling robot. 20 nm gold nanoparticles (Ted Pella, Inc., #15705) were coated with a mixture of 80% goat anti-human Fc (Jackson ImmunoResearch Laboratories, Inc. #109-005-098) and 20% non-specific goat polyclonal antibodies (Jackson ImmunoResearch Laboratories, Inc. #005-000-003) that were buffer exchanged into 20 mM sodium acetate pH 4.3 and diluted to 0.4 mg/ml. After one hour incubation at room temperature, sites unoccupied on the gold nanoparticles were blocked with thiolated polyethylene glycol (2 kD). The coated nanoparticles were then concentrated 10-fold using a syringe filter and 10 µl were added to 100 µl of mAb at 0.05 mg/ml in PBS pH 7.2. The coated nanoparticles were incubated with the antibody of interest for 2 hrs in a 96-well polypropylene plate and then transferred to a 384-well polystyrene plate and read on a Tecan M1000 spectrophotometer. The absorbance was read from 450-650 in 2 nm increments, and a Microsoft Excel macro was used to identify the max absorbance, smooth the data, and fit the data using a second-order polynomial. The smoothed max absorbance of the average blank (PBS buffer alone) was subtracted from the smoothed max absorbance of the antibody sample to determine the antibody AC-SINS score. Table 35 shows an AC-SINS non-specificity assay for optimized CD3-GUCY2c bispecific antibodies shows low potential for self-interaction and non-specificity.

TABLE 35

| Clone | AC-SINS |
|---|---|
| GUCY2C-0405 | 4 |
| GUCY2C-0486 | 7 |
| GUCY2C-1186 | 2 |
| GUCY2C-1467 | 2 |
| GUCY2C-1476 | 2 |

TABLE 35-continued

| Clone | AC-SINS |
|---|---|
| GUCY2C-1478 | 2 |
| GUCY2C-1481 | 2 |
| GUCY2C-1518 | 1 |
| GUCY2C-1526 | 2 |
| GUCY2C-1538 | 2 |
| GUCY2C-1554 | 1 |
| GUCY2C-1555 | 1 |
| GUCY2C-1556 | 0 |
| GUCY2C-1557 | 1 |
| GUCY2C-1590 | 0 |
| GUCY2C-1591 | 1 |
| GUCY2C-1592 | 1 |
| GUCY2C-1608 | 1 |

Example 24

Stable Cell Line Generation, Expression and Purification of GUCY2c-1608 Bispecific Antibody The two chains coding for GUCY2C-1608 bispecific antibody were cloned into the mammalian expression vector pRY19-GA-Q containing a dual promoter and recombination site for single-site integration (SSI) (Zhang, L. et al. Biotechnology Progress., 31: 1645-1656, 2015) into the CHO cell genome. SSI relies on the insertion of the gene of interest using a recombinase-based cassette exchange at a known chromosomal location known for high stable gene expression. The GUCY2C-1608-Hole and GUCY2C-1608-Knob constructs were cloned into our expression vector in cassette one and two respectively. The resulting GUCY2C-1608 plasmid was transfected into CHO-K1 SV 10E9 cells via electroporation with the pRY19 vector containing the gene of interest followed by positive and negative selection pressure using hygromycin-B and ganciclovir. These CHO pools went through a 3 week recovery phase. When observed viabilities were in excess of 90%, cell banks were generated for future work. The established CHO-pools were then subjected to a 12-day fed-batch platform expression process in CD-CHO media (ThermoFisher Scientific, Waltham, Mass.). At the end of the 12-day process, cells were centrifuged at 3000×g for 10 minutes followed by sterile filtering of the conditioned media using a 0.2 um PES bottle top filter (Corning, Oneonta, N.Y.). Additionally, the stable CHO pools were scaled for a 10 L controlled rocking bioreactor (Finesse, Santa Clara, Calif.). CHO pools were grown in Pfizer proprietary media in a 12-day fed-batch that included chemically defined feeds to maintain culture viability. When completed the culture was depth filtered using a filter train consisting of a 20" 5 um Pall Profile II followed by a 10" 0.2 um Pall Supor (Pall Corporation, Port Washington, N.Y.). Titers were evaluated using protein-A affinity chromatography. Protein purification was then performed utilizing techniques known in the art including Protein A chromatography, hydrophobic interaction chromatography and ion-exchange chromatography. The protein expression titer for GUCY2C-1608 from a stably transfected CHO cell pool are shown in Table 36. Expression titers for GUCY2C-1608 clone pools exhibited expression levels between 0.48 and 0.84 grams/liter.

TABLE 36

| Clone Pool | Expression g/L |
|---|---|
| Pool A | 0.842 |
| Pool B | 0.710 |
| Pool C | 0.480 |

Example 25

Mass Spectrometric Analysis of GUCY2C-1608 Bispecific Antibody

LC/MS analysis was carried out to confirm the generation of correctly paired GUCY2C-1608 purified bispecific antibody. The molecular weights of bispecific molecule are defined by their unique amino acid sequences, and accurate molecular weight determination provides evidence for the presence of correctly paired GUCY2c bispecific molecules. Briefly, the CD3-GUCY2c bispecific sample was analyzed by LC/MS analysis on a Waters Acquity H-Class HPLC coupled with a Bruker maXis II Q-ToF mass spectrometer. The analytes were loaded onto a SMT SAM C2 column (2.1 mm×100 mm, maintained at 80° C.) and eluted using a tertiary gradient of buffer B (80% 1-propanol, 20% acetonitrile, with 0.05% trifluoroacetic acid) and buffer C (100% acetonitrile with 0.05% trifluoroacetic acid) at a flow rate of 300 µl/min (5 min ramp to 19% B and 4% C, 20 min ramp to 22% B and 16% C, 10 min ramp to 0% B and 98% C. Mass spectrometric detection was carried out in positive mode with capillary voltage set at 3.5 kV. Data analysis was performed with MaxEnt 1 deconvolution in Compass DataAnalysis v4.2. FIG. 17 shows high purity at the predicted molecular weight of the final purified GUCY2C-1608 bispecific antibody.

Example 26

Sequences

Tables 37A and 37B provide a summary of the antibody or antibody fragments SEQ ID NOs as discussed herein. Table 37A uses ABM numbering system for VH CDR1s sequences. Table 37A uses Kabat numbering system for all other sequences including VH CDR2s.

TABLE 37A

| Sequence | CDR_H1 | CDR_H2 | CDR_H3 | CDR_L1 | CDR_L2 | CDR_L3 | FV_H | FV_L | FVV_H1 | FVV_H2 |
|---|---|---|---|---|---|---|---|---|---|---|
| CD3-0001 | 2 | 3 | 4 | 77 | 78 | 79 | 1 | 76 | 5 | 6 |
| CD3-0004 | 2 | 3 | 4 | 85 | 78 | 79 | 1 | 84 | 5 | 6 |
| CD3-0006 | 2 | 10 | 4 | 91 | 78 | 79 | 9 | 90 | 5 | 6 |
| GUCY2C-0074 | 12 | 13 | 14 | 93 | 94 | 95 | 11 | 92 | 15 | 16 |
| GUCY2C-0077 | 20 | 21 | 22 | 101 | 102 | 95 | 19 | 100 | 23 | 24 |
| GUCY2C-0078 | 20 | 21 | 22 | 105 | 102 | 95 | 19 | 104 | 23 | 24 |
| GUCY2C-0098 | 27 | 28 | 29 | 107 | 108 | 109 | 26 | 106 | 30 | 16 |
| GUCY2C-0104 | 34 | 35 | 36 | 113 | 114 | 115 | 33 | 112 | 37 | 38 |
| GUCY2C-0105 | 42 | 43 | 44 | 120 | 78 | 121 | 41 | 119 | 45 | 46 |
| GUCY2C-0240 | 12 | 13 | 14 | 93 | 94 | 95 | 48 | 125 | 5 | 49 |
| GUCY2C-0315 | 12 | 53 | 14 | 93 | 94 | 95 | 52 | 129 | 54 | 55 |
| GUCY2C-0179 | 42 | 43 | 44 | 120 | 78 | 121 | 57 | 134 | 5 | 49 |
| GUCY2C-0193 | 27 | 28 | 29 | 107 | 108 | 109 | 60 | 136 | 5 | 49 |
| GUCY2C-0210 | 27 | 28 | 29 | 107 | 108 | 109 | 62 | 137 | 5 | 63 |
| GUCY2C-0212 | 27 | 28 | 29 | 107 | 108 | 109 | 64 | 137 | 5 | 49 |
| GUCY2C-0241 | 27 | 28 | 29 | 107 | 108 | 109 | 60 | 137 | 5 | 49 |
| GUCY2C-0247 | 27 | 28 | 29 | 107 | 108 | 109 | 60 | 138 | 5 | 49 |
| GUCY2C-1186 | 27 | 66 | 29 | 107 | 141 | 142 | 65 | 140 | 5 | 49 |
| GUCY2C-1467 | 27 | 28 | 29 | 107 | 144 | 109 | 60 | 143 | 5 | 49 |
| GUCY2C-1476 | 27 | 68 | 29 | 107 | 146 | 142 | 67 | 145 | 5 | 49 |
| GUCY2C-1478 | 27 | 70 | 29 | 148 | 149 | 142 | 69 | 147 | 5 | 49 |
| GUCY2C-1481 | 27 | 70 | 29 | 107 | 151 | 142 | 69 | 150 | 5 | 49 |
| GUCY2C-1512 | 27 | 72 | 29 | 153 | 141 | 154 | 71 | 152 | 5 | 49 |
| GUCY2C-1518 | 27 | 70 | 29 | 153 | 157 | 142 | 69 | 156 | 5 | 49 |
| GUCY2C-1526 | 27 | 68 | 29 | 153 | 159 | 142 | 67 | 158 | 5 | 49 |
| GUCY2C-1527 | 27 | 70 | 29 | 107 | 161 | 154 | 69 | 160 | 5 | 49 |
| GUCY2C-1538 | 27 | 68 | 29 | 163 | 164 | 165 | 67 | 162 | 5 | 49 |
| GUCY2C-1554 | 74 | 75 | 29 | 167 | 168 | 169 | 73 | 166 | 5 | 49 |
| GUCY2C-1555 | 74 | 75 | 29 | 167 | 149 | 169 | 73 | 170 | 5 | 49 |
| GUCY2C-1556 | 74 | 75 | 29 | 167 | 168 | 142 | 73 | 171 | 5 | 49 |
| GUCY2C-1557 | 74 | 75 | 29 | 167 | 149 | 142 | 73 | 172 | 5 | 49 |
| GUCY2C-1590 | 74 | 75 | 29 | 148 | 168 | 169 | 73 | 173 | 5 | 49 |
| GUCY2C-1591 | 74 | 75 | 29 | 148 | 149 | 169 | 73 | 174 | 5 | 49 |
| GUCY2C-1592 | 74 | 75 | 29 | 148 | 168 | 142 | 73 | 175 | 5 | 49 |
| GUCY2C-1608 | 74 | 75 | 29 | 148 | 149 | 142 | 73 | 147 | 5 | 49 |
| huIGHV3-7 | 177 | 178 | 179 | NA | NA | NA | 176 | NA | 5 | 6 |
| huIGKV1-39 | NA | NA | NA | 181 | 182 | 183 | NA | 180 | NA | NA |
| GUCY2C-0405 | 27 | 70 | 29 | 148 | 149 | 142 | 69 | 147 | 5 | 49 |
| GUCY2C-0486 | 27 | 70 | 29 | 148 | 149 | 142 | 69 | 147 | 5 | 49 |
| GUCY2C-1640 | 74 | 75 | 29 | 148 | 149 | 142 | 73 | 147 | 5 | 49 |
| GUCY2C-0250 | 27 | 28 | 29 | 107 | 108 | 109 | 60 | 137 | 5 | 49 |

| Sequence | FVV_H3 | FVV_H4 | FVV_L1 | FVV_L2 | FVV_L3 | FVV_L4 | Linker-1 | Linker-2 |
|---|---|---|---|---|---|---|---|---|
| CD3-0001 | 7 | 8 | 80 | 81 | 82 | 83 | NA | NA |
| CD3-0004 | 7 | 8 | 86 | 87 | 88 | 89 | NA | NA |
| CD3-0006 | 7 | 8 | 80 | 81 | 82 | 83 | NA | NA |
| GUCY2C-0074 | 17 | 18 | 96 | 97 | 98 | 99 | 190 | NA |
| GUCY2C-0077 | 25 | 18 | 96 | 97 | 103 | 99 | 190 | NA |
| GUCY2C-0078 | 25 | 18 | 96 | 97 | 103 | 99 | 190 | NA |
| GUCY2C-0098 | 31 | 32 | 96 | 110 | 111 | 99 | 190 | NA |
| GUCY2C-0104 | 39 | 40 | 116 | 110 | 117 | 118 | 190 | NA |
| GUCY2C-0105 | 47 | 32 | 122 | 123 | 124 | 99 | 190 | NA |
| GUCY2C-0240 | 50 | 51 | 126 | 127 | 82 | 128 | 190 | NA |

TABLE 37A-continued

|  |  |  |  |  |  |  |  |  |
|---|---|---|---|---|---|---|---|---|
| GUCY2C-0315 | 56 | 51 | 130 | 131 | 132 | 133 | NA | NA |
| GUCY2C-0179 | 58 | 59 | 80 | 135 | 82 | 83 | NA | NA |
| GUCY2C-0193 | 61 | 51 | 80 | 81 | 82 | 128 | NA | NA |
| GUCY2C-0210 | 7 | 51 | 126 | 81 | 82 | 128 | NA | NA |
| GUCY2C-0212 | 7 | 51 | 126 | 81 | 82 | 128 | NA | NA |
| GUCY2C-0241 | 61 | 51 | 126 | 81 | 82 | 128 | NA | NA |
| GUCY2C-0247 | 61 | 51 | 126 | 139 | 82 | 128 | 190 | NA |
| GUCY2C-1186 | 61 | 51 | 126 | 81 | 82 | 128 | 190 | NA |
| GUCY2C-1467 | 61 | 51 | 126 | 81 | 82 | 128 | 190 | NA |
| GUCY2C-1476 | 61 | 51 | 126 | 81 | 82 | 128 | 190 | NA |
| GUCY2C-1478 | 61 | 51 | 126 | 81 | 82 | 128 | 190 | 191 |
| GUCY2C-1481 | 61 | 51 | 126 | 81 | 82 | 128 | 190 | NA |
| GUCY2C-1512 | 61 | 51 | 126 | 81 | 82 | 155 | 190 | NA |
| GUCY2C-1518 | 61 | 51 | 126 | 81 | 82 | 128 | 190 | NA |
| GUCY2C-1526 | 61 | 51 | 126 | 81 | 82 | 128 | 190 | NA |
| GUCY2C-1527 | 61 | 51 | 126 | 81 | 82 | 128 | 190 | NA |
| GUCY2C-1538 | 61 | 51 | 126 | 81 | 82 | 128 | 190 | NA |
| GUCY2C-1554 | 61 | 51 | 80 | 81 | 82 | 128 | 190 | NA |
| GUCY2C-1555 | 61 | 51 | 80 | 81 | 82 | 128 | 190 | NA |
| GUCY2C-1556 | 61 | 51 | 80 | 81 | 82 | 128 | 190 | NA |
| GUCY2C-1557 | 61 | 51 | 80 | 81 | 82 | 128 | 190 | NA |
| GUCY2C-1590 | 61 | 51 | 126 | 81 | 82 | 128 | 190 | NA |
| GUCY2C-1591 | 61 | 51 | 126 | 81 | 82 | 128 | 190 | NA |
| GUCY2C-1592 | 61 | 51 | 126 | 81 | 82 | 128 | 190 | NA |
| GUCY2C-1608 | 61 | 51 | 126 | 81 | 82 | 128 | 190 | 191 |
| huIGHV3-7 | 7 | NA | NA | NA | NA | NA | NA | NA |
| huIGKV1-39 | NA | NA | 80 | 81 | 82 | NA | NA | NA |
| GUCY2C-0405 | 61 | 51 | 126 | 81 | 82 | 128 | NA | NA |
| GUCY2C-0486 | 61 | 51 | 126 | 81 | 82 | 128 | NA | NA |
| GUCY2C-1640 | 61 | 51 | 126 | 81 | 82 | 128 | NA | NA |
| GUCY2C-0250 | 61 | 51 | 126 | 81 | 82 | 128 | 190 | NA |

TABLE 37B

| Sequence | Linker-3 | Linker-4 | Linker-5 | Linker-6 | Humen IgG1 CL1 | Humen IgG1 CH1 | Humen IgG1 Hnge | Humen IgG1 Fc (CH2—CH3) | Anti-CD3_CH | Anti-CD3_VL |
|---|---|---|---|---|---|---|---|---|---|---|
| CD3-0001 | NA | NA | NA | NA | NA | NA | NA | NA | 1 | 76 |
| CD3-0004 | NA | NA | NA | NA | NA | NA | NA | NA | 1 | 84 |
| CD3-0006 | NA | NA | NA | NA | NA | NA | NA | NA | 9 | 90 |
| GUCY2C-0074 | 192 | NA | NA | NA | NA | NA | NA | NA | 1 | 84 |
| GUCY2C-0077 | 192 | NA | NA | NA | NA | NA | NA | NA | 1 | 84 |
| GUCY2C-0078 | 192 | NA | NA | NA | NA | NA | NA | NA | 1 | 84 |
| GUCY2C-0098 | 192 | NA | NA | NA | NA | NA | NA | NA | 1 | 84 |
| GUCY2C-0104 | 192 | NA | NA | NA | NA | NA | NA | NA | 1 | 84 |
| GUCY2C-0105 | 192 | NA | NA | NA | NA | NA | NA | NA | 1 | 84 |
| GUCY2C-0240 | 192 | NA | NA | NA | NA | NA | NA | NA | 1 | 84 |
| GUCY2C-0315 | NA | NA | NA | NA | 184 | 185 | 186 | 187 | NA | NA |
| GUCY2C-0179 | NA | NA | NA | NA | 184 | 185 | 186 | 187 | NA | NA |
| GUCY2C-0193 | NA | NA | NA | NA | 184 | 185 | 186 | 187 | NA | NA |
| GUCY2C-0210 | NA | NA | NA | NA | 184 | 185 | 186 | 187 | NA | NA |
| GUCY2C-0212 | NA | NA | NA | NA | 184 | 185 | 186 | 187 | NA | NA |
| GUCY2C-0241 | NA | NA | NA | NA | 184 | 185 | 186 | 187 | NA | NA |
| GUCY2C-0247 | 192 | NA | NA | NA | NA | NA | NA | NA | 1 | 84 |
| GUCY2C-1186 | 192 | NA | NA | NA | NA | NA | NA | NA | 1 | 84 |
| GUCY2C-1467 | 192 | NA | NA | NA | NA | NA | NA | NA | 1 | 84 |
| GUCY2C-1476 | 192 | NA | NA | NA | NA | NA | NA | NA | 1 | 84 |
| GUCY2C-1478 | 192 | NA | NA | NA | NA | NA | NA | NA | 9 | 90 |
| GUCY2C-1481 | 192 | NA | NA | NA | NA | NA | NA | NA | 1 | 84 |
| GUCY2C-1512 | 192 | NA | NA | NA | NA | NA | NA | NA | 1 | 84 |
| GUCY2C-1518 | 192 | NA | NA | NA | NA | NA | NA | NA | 1 | 84 |
| GUCY2C-1526 | 192 | NA | NA | NA | NA | NA | NA | NA | 1 | 84 |
| GUCY2C-1527 | 192 | NA | NA | NA | NA | NA | NA | NA | 1 | 84 |
| GUCY2C-1538 | 192 | NA | NA | NA | NA | NA | NA | NA | 1 | 84 |
| GUCY2C-1554 | 192 | NA | NA | NA | NA | NA | NA | NA | 1 | 84 |
| GUCY2C-1555 | 192 | NA | NA | NA | NA | NA | NA | NA | 1 | 84 |
| GUCY2C-1556 | 192 | NA | NA | NA | NA | NA | NA | NA | 1 | 84 |
| GUCY2C-1557 | 192 | NA | NA | NA | NA | NA | NA | NA | 1 | 84 |
| GUCY2C-1590 | 192 | NA | NA | NA | NA | NA | NA | NA | 1 | 84 |
| GUCY2C-1591 | 192 | NA | NA | NA | NA | NA | NA | NA | 1 | 84 |
| GUCY2C-1592 | 192 | NA | NA | NA | NA | NA | NA | NA | 1 | 84 |
| GUCY2C-1608 | 192 | NA | NA | NA | NA | NA | NA | NA | 9 | 90 |
| huIGHV3-7 | NA | NA | NA | NA | NA | NA | NA | NA | NA | NA |
| huIGKV1-39 | NA | NA | NA | NA | NA | NA | NA | NA | NA | NA |
| GUCY2C-0405 | NA | 193 | 194 | 195 | NA | NA | NA | 187 | NA | NA |

TABLE 37B-continued

| | | | | | | | | | |
|---|---|---|---|---|---|---|---|---|---|
| GUCY2C-0486 | NA | NA | NA | NA | 184 | 185 | 186 | 187 | NA | NA |
| GUCY2C-1640 | NA | NA | NA | NA | 184 | 185 | 186 | 187 | NA | NA |
| GUCY2C-0250 | 192 | NA | NA | NA | NA | NA | NA | NA | 1 | 76 |

| Sequence | Knob Fc chain | Hide Fc chain | IgG Light Chain | IgG Heavy Chain | VL-Knob | VH-H-ble | Full Sequence | Nuclectide of first polypeptide chain | Nuclectide of second polypeptide chain |
|---|---|---|---|---|---|---|---|---|---|
| CD3-0001 | NA | NA | NA | NA | NA | NA | NA | NA | NA |
| CD3-0004 | NA | NA | NA | NA | NA | NA | NA | NA | NA |
| CD3-0006 | NA | NA | NA | NA | NA | NA | NA | NA | NA |
| GUCY2C-0074 | 188 | 189 | NA | NA | 196 | 197 | 198 | NA | NA |
| GUCY2C-0077 | 188 | 189 | NA | NA | NA | NA | NA | NA | NA |
| GUCY2C-0078 | 188 | 189 | NA | NA | NA | NA | NA | NA | NA |
| GUCY2C-0098 | 188 | 189 | NA | NA | 199 | 200 | 201 | NA | NA |
| GUCY2C-0104 | 188 | 189 | NA | NA | NA | NA | NA | NA | NA |
| GUCY2C-0105 | 188 | 189 | NA | NA | 202 | 203 | 204 | NA | NA |
| GUCY2C-0240 | 188 | 189 | NA | NA | 205 | 206 | 207 | NA | NA |
| GUCY2C-0315 | NA | NA | 214 | 223 | NA | NA | NA | NA | NA |
| GUCY2C-0179 | NA | NA | 214 | 223 | NA | NA | NA | NA | NA |
| GUCY2C-0193 | NA | NA | 214 | 223 | NA | NA | NA | NA | NA |
| GUCY2C-0210 | NA | NA | 214 | 223 | NA | NA | NA | NA | NA |
| GUCY2C-0212 | NA | NA | 214 | 223 | NA | NA | NA | NA | NA |
| GUCY2C-0241 | NA | NA | 208 | 209 | NA | NA | NA | NA | NA |
| GUCY2C-0247 | 188 | 189 | NA | NA | 210 | 211 | 212 | NA | NA |
| GUCY2C-1186 | 188 | 189 | NA | NA | NA | NA | NA | NA | NA |
| GUCY2C-1467 | 188 | 189 | NA | NA | NA | NA | NA | NA | NA |
| GUCY2C-1476 | 188 | 189 | NA | NA | NA | NA | NA | NA | NA |
| GUCY2C-1478 | 188 | 189 | NA | NA | 216 | 217 | 218 | NA | NA |
| GUCY2C-1481 | 188 | 189 | NA | NA | NA | NA | NA | NA | NA |
| GUCY2C-1512 | 188 | 189 | NA | NA | NA | NA | NA | NA | NA |
| GUCY2C-1518 | 188 | 189 | NA | NA | NA | NA | NA | NA | NA |
| GUCY2C-1526 | 188 | 189 | NA | NA | NA | NA | NA | NA | NA |
| GUCY2C-1527 | 188 | 189 | NA | NA | NA | NA | NA | NA | NA |
| GUCY2C-1538 | 188 | 189 | NA | NA | NA | NA | NA | NA | NA |
| GUCY2C-1554 | 188 | 189 | NA | NA | NA | NA | NA | NA | NA |
| GUCY2C-1555 | 188 | 189 | NA | NA | NA | NA | NA | NA | NA |
| GUCY2C-1556 | 188 | 189 | NA | NA | NA | NA | NA | NA | NA |
| GUCY2C-1557 | 188 | 189 | NA | NA | NA | NA | NA | NA | NA |
| GUCY2C-1590 | 188 | 189 | NA | NA | NA | NA | NA | NA | NA |
| GUCY2C-1591 | 188 | 189 | NA | NA | NA | NA | NA | NA | NA |
| GUCY2C-1592 | 188 | 189 | NA | NA | NA | NA | NA | NA | NA |
| GUCY2C-1608 | 188 | 189 | NA | NA | 216 | 220 | 221 | 246 | 247 |
| huIGHV3-7 | NA | NA | NA | NA | NA | NA | NA | NA | NA |
| huIGKV1-39 | NA | NA | NA | NA | NA | NA | NA | NA | NA |
| GUCY2C-0405 | NA | NA | NA | NA | NA | NA | 213 | NA | NA |
| GUCY2C-0486 | NA | NA | 214 | 215 | NA | NA | NA | NA | NA |
| GUCY2C-1640 | NA | NA | 214 | 223 | NA | NA | NA | NA | NA |
| GUCY2C-0250 | 188 | 189 | NA | NA | 248 | 249 | 250 | NA | NA |

Table 38 provides sequences referred to herein.

TABLE 38

| SEQ ID NO: | Description | Sequence |
|---|---|---|
| 1 | CD3-0001_VH | EVQLVESGGGLVQPGGSLRLSCAASGFTFSDYYMTWVRQ APGKGLEWVAFIRNRARGYTSDHNPSVKGRFTISRDNAKN SLYLQMNSLRAEDTAVYYCARDRPSYYVLDYWGQGTTVTV SS |
| 2 | CD3-0001_VH, 2B5-1038 VH, 2B5-1039 VH, 2B5-1040 VH, CDR1 (extended/ABM) | GFTFSDYYMT |
| 3 | CD3-0001_VH CDR2 | FIRNRARGYTSDHNPSVKG |
| 4 | CD3-0001_VH, 2B5-1038 VH, 2B5-1039 VH, 2B5-1040 VH, CDR3 | DRPSYYVLDY |

TABLE 38-continued

| SEQ ID NO: | Description | Sequence |
|---|---|---|
| 5 | CD3-0001_VH FW_H1 | EVQLVESGGGLVQPGGSLRLSCAAS |
| 6 | CD3-0001_VH FW_H2 | WVRQAPGKGLEWVA |
| 7 | CD3-0001_VH FW_H3 | RFTISRDNAKNSLYLQMNSLRAEDTAVYYCAR |
| 8 | CD3-0001_VH FW_H4 | WGQGTTVTVSS |
| 9 | CD3-0006_VH | EVQLVESGGGLVQPGGSLRLSCAASGFTFSDYYMTWVRQ APGKGLEWVAFIRNQARGYTSDHNPSVKGRFTISRDNAKN SLYLQMNSLRAEDTAVYYCARDRPSYYVLDYWGQGTTVTV SS |
| 10 | CD3-0006_VH, 2B5-1038 VH, 2B5-1039 VH, 2B5-1040 VH, CDR2 (Kabat) | FIRNQARGYTSDHNPSVKG |
| 11 | GUCY2C-0074_VH | EVQLQQSGAELARPGASVNLSCKASGYTFTTYWMQWVKQ RPGQGLEWIGAIYPGDGMTTYTQKFKDKATLTADKSSSTAY MQLSSLASEDSAVYYCVRKGMDYWGQGTSVTVSS |
| 12 | GUCY2C-0074_VH CDR1 | GYTFTTYWMQ |
| 13 | GUCY2C-0074_VH CDR2 | AIYPGDGMTTYTQKFKD |
| 14 | GUCY2C-0074_VH CDR3 | KGMDY |
| 15 | GUCY2C-0074_VH FW_H1 | EVQLQQSGAELARPGASVNLSCKAS |
| 16 | GUCY2C-0074_VH FW_H2 | WVKQRPGQGLEWIG |
| 17 | GUCY2C-0074_VH FW_H3 | KATLTADKSSSTAYMQLSSLASEDSAVYYCVR |
| 18 | GUCY2C-0074_VH FW_H4 | WGQGTSVTVSS |
| 19 | GUCY2C-0077_VH | EVQLQQSGAELARPGASVKLSCKASGYTFTKYWMQWIKQ RPGQGLEWIGAIYPGDGFTTYTQKFKGKATLTADKSSNTAY MQLSSLASEDSAVYYCARRNYGRTYGGDYWGQGTSVTVSS |
| 20 | GUCY2C-0077_VH CDR1 | GYTFTKYWMQ |
| 21 | GUCY2C-0077_VH CDR2 | AIYPGDGFTTYTQKFKG |
| 22 | GUCY2C-0077_VH CDR3 | RNYGRTYGGDY |
| 23 | GUCY2C-0077_VH FW_H1 | EVQLQQSGAELARPGASVKLSCKAS |
| 24 | GUCY2C-0077_VH FW_H2 | WIKQRPGQGLEWIG |
| 25 | GUCY2C-0077_VH FW_H3 | KATLTADKSSNTAYMQLSSLASEDSAVYYCAR |
| 26 | GUCY2C-0098_VH | QVQLQQPGAELVKPGASVKLSCKASGYTFTSYWMHWVKQ RPGQGLEWIGEIKPSNGLTNYIEKFKNKATLTVDKSATTAY MQLSSLTAEDSAVYYCTRTITTTEGYWFFDVWGAGTTVTV SS |

TABLE 38-continued

| SEQ ID NO: | Description | Sequence |
|---|---|---|
| 27 | GUCY2C-0098_VH CDR1 | GYTFTSYWMH |
| 28 | GUCY2C-0098_VH CDR2 | EIKPSNGLTNYIEKFKN |
| 29 | GUCY2C-0098_VH CDR3 | TITTTEGYWFFDV |
| 30 | GUCY2C-0098_VH FW_H1 | QVQLQQPGAELVKPGASVKLSCKAS |
| 31 | GUCY2C-0098_VH FW_H3 | KATLTVDKSATTAYMQLSSLTAEDSAVYYCTR |
| 32 | GUCY2C-0098_VH FW_H4 | WGAGTTVTVSS |
| 33 | GUCY2C-0104_VH | EVQLQQSGAELVKPGASVKLSCTASGFNIKDTYIHWVKQRPEQGLEWIGRIDPANGNANYDPKFQGKATITADTSSNTAYLQLSSLTSEDTAVFYCSSLGTGTYWGQGTTLTVSS |
| 34 | GUCY2C-0104_VH CDR1 | GFNIKDTYIH |
| 35 | GUCY2C-0104_VH CDR2 | RIDPANGNANYDPKFQG |
| 36 | GUCY2C-0104_VH CDR3 | LGTGTY |
| 37 | GUCY2C-0104_VH FW_H1 | EVQLQQSGAELVKPGASVKLSCTAS |
| 38 | GUCY2C-0104_VH FW_H2 | WVKQRPEQGLEWIG |
| 39 | GUCY2C-0104_VH FW_H3 | KATITADTSSNTAYLQLSSLTSEDTAVFYCSS |
| 40 | GUCY2C-0104_VH FW_H4 | WGQGTTLTVSS |
| 41 | GUCY2C-0105_VH | EVQLQQSGPELVKPGASVKISCKASGYSFTDYIMLWVKQSHGKSLEWIGNSNPYYGSTSYNLKFKGKATLTVDKSSSTAYMHLNSLTSEDSAVYYCARSGYYGSSPYWYFDVWGAGTTVTVSS |
| 42 | GUCY2C-0105_VH CDR1 | GYSFTDYIML |
| 43 | GUCY2C-0105_VH CDR2 | NSNPYYGSTSYNLKFKG |
| 44 | GUCY2C-0105_VH CDR3 | SGYYGSSPYWYFDV |
| 45 | GUCY2C-0105_VH FW_H1 | EVQLQQSGPELVKPGASVKISCKAS |
| 46 | GUCY2C-0105_VH FW_H2 | WVKQSHGKSLEWIG |
| 47 | GUCY2C-0105_VH FW_H3 | KATLTVDKSSSTAYMHLNSLTSEDSAVYYCAR |
| 48 | GUCY2C-0240_VH | EVQLVESGGGLVQPGGSLRLSCAASGYTFTTYWMQWVRQAPGKGLEWIGAIYPGDGMTTYTQKFKDRFTISADKAKNSAYLQMNSLRAEDTAVYYCVRKGMDYWGQGTLVTVSS |
| 49 | GUCY2C-0240_VH FW_H2 | WVRQAPGKGLEWIG |
| 50 | GUCY2C-0240_VH FW_H3 | RFTISADKAKNSAYLQMNSLRAEDTAVYYCVR |

TABLE 38-continued

| SEQ ID NO: | Description | Sequence |
|---|---|---|
| 51 | GUCY2C-0240_VH FW_H4 | WGQGTLVTVSS |
| 52 | GUCY2C-0315_VH | QVQLVQSGAEVKKPGASVKVSCKASGYTFTTYWMQWVRQ APGQGLEWIGAIYPGDMTTYTQKFQGRVTMTRDTSTSTV YMELSSLRSEDTAVYYCVRKGMDYWGQGTLVTVSS |
| 53 | GUCY2C-0315_VH CDR2 | AIYPGDMTTYTQKFQG |
| 54 | GUCY2C-0315_VH FW_H1 | QVQLVQSGAEVKKPGASVKVSCKAS |
| 55 | GUCY2C-0315_VH FW_H2 | WVRQAPGQGLEWIG |
| 56 | GUCY2C-0315_VH FW_H3 | RVTMTRDTSTSTVYMELSSLRSEDTAVYYCVR |
| 57 | GUCY2C-0179_VH | EVQLVESGGGLVQPGGSLRLSCAASGYSFTDYIMLWVRQA PGKGLEWIGNSNPYYGSTSYNLKFKGRFTISVDKAKNSAYL QMNSLRAEDTAVYYCARSGYYGSSPYWYFDVWGQGTMV TVSS |
| 58 | GUCY2C-0179_VH FW_H3 | RFTISVDKAKNSAYLQMNSLRAEDTAVYYCAR |
| 59 | GUCY2C-0179_VH FW_H4 | WGQGTMVTVSS |
| 60 | GUCY2C-0193_VH | EVQLVESGGGLVQPGGSLRLSCAASGYTFTSYWMHWVRQ APGKGLEWIGEIKPSNGLTNYIEKFKNRFTISVDKAKNSAYL QMNSLRAEDTAVYYCTRTITTTEGYWFFDVWGQGTLVTVSS |
| 61 | GUCY2C-0193_VH FW_H3 | RFTISVDKAKNSAYLQMNSLRAEDTAVYYCTR |
| 62 | GUCY2C-0210_VH | EVQLVESGGGLVQPGGSLRLSCAASGYTFTSYWMHWVRQ APGKGLEWIAEIKPSNGLTNYIEKFKNRFTISRDNAKNSLYL QMNSLRAEDTAVYYCARTITTTEGYWFFDVWGQGTLVTVSS |
| 63 | GUCY2C-0210_VH FW_H2 | WVRQAPGKGLEWIA |
| 64 | GUCY2C-0212_VH | EVQLVESGGGLVQPGGSLRLSCAASGYTFTSYWMHWVRQ APGKGLEWIGEIKPSNGLTNYIEKFKNRFTISRDNAKNSLYL QMNSLRAEDTAVYYCARTITTTEGYWFFDVWGQGTLVTVSS |
| 65 | GUCY2C-1186_VH | EVQLVESGGGLVQPGGSLRLSCAASGYTFTSYWMHWVRQ APGKGLEWIGEIKPSNGLTNIHPKFKNRFTISVDKAKNSAYL QMNSLRAEDTAVYYCTRTITTTEGYWFFDVWGQGTLVTVSS |
| 66 | GUCY2C-1186_VH CDR2 | EIKPSNGLTNIHPKFKN |
| 67 | GUCY2C-1476_VH | EVQLVESGGGLVQPGGSLRLSCAASGYTFTSYWMHWVRQ APGKGLEWIGEIKPSNGLTNYNEKFKNRFTISVDKAKNSAYL QMNSLRAEDTAVYYCTRTITTTEGYWFFDVWGQGTLVTVSS |
| 68 | GUCY2C-1476_VH CDR2 | EIKPSNGLTNYNEKFKN |
| 69 | GUCY2C-1478_VH | EVQLVESGGGLVQPGGSLRLSCAASGYTFTSYWMHWVRQ APGKGLEWIGEIKPSNGLTNVHEKFKNRFTISVDKAKNSAYL QMNSLRAEDTAVYYCTRTITTTEGYWFFDVWGQGTLVTVSS |
| 70 | GUCY2C-1478_VH CDR2 | EIKPSNGLTNVHEKFKN |
| 71 | GUCY2C-1512_VH | EVQLVESGGGLVQPGGSLRLSCAASGYTFTSYWMHWVRQ APGKGLEWIGEIKPSNGLTNYAEQFKNRFTISVDKAKNSAY LQMNSLRAEDTAVYYCTRTITTTEGYWFFDVWGQGTLVTV SS |
| 72 | GUCY2C-1512_VH CDR2 | EIKPSNGLTNYAEQFKN |

TABLE 38-continued

| SEQ ID NO: | Description | Sequence |
|---|---|---|
| 73 | GUCY2C-1554_VH; GUCY2C-1608_VH | EVQLVESGGGLVQPGGSLRLSCAASGFTFSSYWMHWVRQ APGKGLEWIGEIKPSNELTNVHEKFKDRFTISVDKAKNSAYL QMNSLRAEDTAVYYCTRTITTTEGYWFFDVWGQGTLVTVSS |
| 74 | GUCY2C-1554_VH CDR1 | GFTFSSYWMH |
| 75 | GUCY2C-1554_VH CDR2 | EIKPSNELTNVHEKFKD |
| 76 | CD3-0001_VL | DIQMTQSPSSLSASVGDRVTITCTSSQSLFNVRSRKNYLAW YQQKPGKAPKLLIYWASTRESGVPSRFSGSGSGTDFTLTIS SLQPEDFATYYCKQSYDLFTFGGGTKVEIK |
| 77 | CD3-0001_VL CDR1 | TSSQSLFNVRSRKNYLA |
| 78 | CD3-0001_VL CDR2 | WASTRES |
| 79 | CD3-0001_VL CDR3 | KQSYDLFT |
| 80 | CD3-0001_VL FW_L1 | DIQMTQSPSSLSASVGDRVTITC |
| 81 | CD3-0001_VL FW_L2 | WYQQKPGKAPKLLIY |
| 82 | CD3-0001_VL FW_L3 | GVPSRFSGSGSGTDFTLTISSLQPEDFATYYC |
| 83 | CD3-0001_VL FW_L4 | FGGGTKVEIK |
| 84 | CD3-0004_VL | DIVMTQSPDSLAVSLGERATINCKSSQSLFNVRSRKNYLAW YQQKPGQPPKLLISWASTRESGVPDRFSGSGSGTDFTLTIS SLQAEDVAVYYCKQSYDLFTFGSGTKLEIK |
| 85 | CD3-0004_VL CDR1 | KSSQSLFNVRSRKNYLA |
| 86 | CD3-0004_VL FW_L1 | DIVMTQSPDSLAVSLGERATINC |
| 87 | CD3-0004_VL FW_L2 | WYQQKPGQPPKLLIS |
| 88 | CD3-0004_VL FW_L3 | GVPDRFSGSGSGTDFTLTISSLQAEDVAVYYC |
| 89 | CD3-0004_VL FW_L4 | FGSGTKLEIK |
| 90 | CD3-0006_VL | DIQMTQSPSSLSASVGDRVTITCTSSQSLFNVRSQKNYLAW YQQKPGKAPKLLIYWASTRESGVPSRFSGSGSGTDFTLTIS SLQPEDFATYYCKQSYDLFTFGGGTKVEIK |
| 91 | CD3-0006_VL CDR1 | TSSQSLFNVRSQKNYLA |
| 92 | GUCY2C-0074_VL | DIVLTQSPASLAVSLGQRATISCRASESVDNYGISFMNWFQ QKPGQPPKLLIYAASNPGSGVPARFSGSGSGTDFSLNIHPL EEDDTAMFFCQQSKEVPYTFGGGTKLEIK |
| 93 | GUCY2C-0074_VL CDR1 | RASESVDNYGISFMN |
| 94 | GUCY2C-0074_VL CDR2 | AASNPGS |
| 95 | GUCY2C-0074_VL CDR3 | QQSKEVPYT |
| 96 | GUCY2C-0074_VL FW_L1 | DIVLTQSPASLAVSLGQRATISC |

TABLE 38-continued

| SEQ ID NO: | Description | Sequence |
|---|---|---|
| 97 | GUCY2C-0074_VL FW_L2 | WFQQKPGQPPKLLIY |
| 98 | GUCY2C-0074_VL FW_L3 | GVPARFSGSGSGTDFSLNIHPLEEDDTAMFFC |
| 99 | GUCY2C-0074_VL FW_L4 | FGGGTKLEIK |
| 100 | GUCY2C-0077_VL | DIVLTQSPASLAVSLGQRATISCRASESVDNFDISFMNWFQQKPGQPPKLLIYAASNQGSGVPARFSGSGSGTDFSLNIHPMEEDDTAMYFCQQSKEVPYTFGGGTKLEIK |
| 101 | GUCY2C-0077_VL CDR1 | RASESVDNFDISFMN |
| 102 | GUCY2C-0077_VL CDR2 | AASNQGS |
| 103 | GUCY2C-0077_VL FW_L3 | GVPARFSGSGSGTDFSLNIHPMEEDDTAMYFC |
| 104 | GUCY2C-0078_VL | DIVLTQSPASLAVSLGQRATISCRAGESVDNFDISFMNWFQQKPGQPPKLLIYAASNQGSGVPARFSGSGSGTDFSLNIHPMEEDDTAMYFCQQSKEVPYTFGGGTKLEIK |
| 105 | GUCY2C-0078_VL CDR1 | RAGESVDNFDISFMN |
| 106 | GUCY2C-0098_VL | DIVLTQSPASLAVSLGQRATISCRASESVDYYGTSLMQWYQQKPGQPPKLLIYAASNVESGVPARFSGSGSGTDFSLNIHPVEEDDIAMYFCQQTRKVYTFGGGTKLEIK |
| 107 | GUCY2C-0098_VL CDR1 | RASESVDYYGTSLMQ |
| 108 | GUCY2C-0098_VL CDR2 | AASNVES |
| 109 | GUCY2C-0098_VL CDR3 | QQTRKVYT |
| 110 | GUCY2C-0098_VL FW_L2 | WYQQKPGQPPKLLIY |
| 111 | GUCY2C-0098_VL FW_L3 | GVPARFSGSGSGTDFSLNIHPVEEDDIAMYFC |
| 112 | GUCY2C-0104_VL | DIVMTQSPASLAVSLGQRATISCRASKGVTTSGYSYMHWYQQKPGQPPKLLIYLASNLESGVPARFSGSGSGTDFTLNIHPVEEEDAATYYCQHSREFPLTFGAGTKLELK |
| 113 | GUCY2C-0104_VL CDR1 | RASKGVTTSGYSYMH |
| 114 | GUCY2C-0104_VL CDR2 | LASNLES |
| 115 | GUCY2C-0104_VL CDR3 | QHSREFPLT |
| 116 | GUCY2C-0104_VL FW_L1 | DIVMTQSPASLAVSLGQRATISC |
| 117 | GUCY2C-0104_VL FW_L3 | GVPARFSGSGSGTDFTLNIHPVEEEDAATYYC |
| 118 | GUCY2C-0104_VL FW_L4 | FGAGTKLELK |
| 119 | GUCY2C-0105_VL | DIVMTQSPSSLAVSVGEKVTVSCKSSQSLLYSSNQKNYLAWYQQRPGQSPKLLIYWASTRESGVPDRFTGSGSGTDFTLSISSVKAEDLAVYYCQQYYSYPTFGGGTKLEIK |
| 120 | GUCY2C-0105_VL CDR1 | KSSQSLLYSSNQKNYLA |

TABLE 38-continued

| SEQ ID NO: | Description | Sequence |
|---|---|---|
| 121 | GUCY2C-0105_VL CDR3 | QQYYSYPT |
| 122 | GUCY2C-0105_VL FW_L1 | DIVMTQSPSSLAVSVGEKVTVSC |
| 123 | GUCY2C-0105_VL FW_L2 | WYQQRPGQSPKLLIY |
| 124 | GUCY2C-0105_VL FW_L3 | GVPDRFTGSGSGTDFTLSISSVKAEDLAVYYC |
| 125 | GUCY2C-0240_VL | DIQLTQSPSSLSASVGDRVTITCRASESVDNYGISFMNWFQQKPGKAPKLLIYAASNPGSGVPSRFSGSGSGTDFTLTISSLQPEDFATYYCQQSKEVPYTFGQGTKLEIK |
| 126 | GUCY2C-0240_VL FW_L1 | DIQLTQSPSSLSASVGDRVTITC |
| 127 | GUCY2C-0240_VL FW_L2 | WFQQKPGKAPKLLIY |
| 128 | GUCY2C-0240_VL FW_L4 | FGQGTKLEIK |
| 129 | GUCY2C-0315_VL | EIVLTQSPATLSLSPGERATLSCRASESVDNYGISFMNWYQQKPGQAPRLLIYAASNPGSGIPARFSGSGSGTDFTLTISSLEPEDFAVYYCQQSKEVPYTFGQGTKVEIK |
| 130 | GUCY2C-0315_VL FW_L1 | EIVLTQSPATLSLSPGERATLSC |
| 131 | GUCY2C-0315_VL FW_L2 | WYQQKPGQAPRLLIY |
| 132 | GUCY2C-0315_VL FW_L3 | GIPARFSGSGSGTDFTLTISSLEPEDFAVYYC |
| 133 | GUCY2C-0315_VL FW_L4 | FGQGTKVEIK |
| 134 | GUCY2C-0179_VL | DIQMTQSPSSLSASVGDRVTITCKSSQSLLYSSNQKNYLAWYQQKPGKSPKLLIYWASTRESGVPSRFSGSGSGTDFTLTISSLQPEDFATYYCQQYYSYPTFGGGTKVEIK |
| 135 | GUCY2C-0179_VL FW_L2 | WYQQKPGKSPKLLIY |
| 136 | GUCY2C-0193_VL | DIQMTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIK |
| 137 | GUCY2C-0210_VL | DIQLTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIK |
| 138 | GUCY2C-0247_VL | DIQLTQSPSSLSASVGDRVTITCRASESVDYYGTSLMQWYQQKPGKPPKLLIYAASNVESGVPSRFSGSGSGTDFTLTISSLQPEDFATYYCQQTRKVYTFGQGTKLEIK |
| 139 | GUCY2C-0247_VL FW_L2 | WYQQKPGKPPKLLIY |
| 140 | GUCY2C-1186_VL | DIQLTQSPSSLSASVGDRVTITCRASESVDYYGTSLMQWYQQKPGKAPKLLIYAASKRYSGVPSRFSGSGSGTDFTLTISSLQPEDFATYYCQQTRKAYTFGQGTKLEIK |
| 141 | GUCY2C-1186_VL CDR2 | AASKRYS |
| 142 | GUCY2C-1186_VL CDR3 | QQTRKAYT |
| 143 | GUCY2C-1467_VL | DIQLTQSPSSLSASVGDRVTITCRASESVDYYGTSLMQWYQQKPGKAPKLLIYAASKLWSGVPSRFSGSGSGTDFTLTISSLQPEDFATYYCQQTRKVYTFGQGTKLEIK |

TABLE 38-continued

| SEQ ID NO: | Description | Sequence |
|---|---|---|
| 144 | GUCY2C-1467_VL CDR2 | AASKLWS |
| 145 | GUCY2C-1476_VL | DIQLTQSPSSLSASVGDRVTITCRASESVDYYGTSLMQWYQQKPGKAPKLLIYAASKVAPGVPSRFSGSGSGTDFTLTISSLQPEDFATYYCQQTRKAYTFGQGTKLEIK |
| 146 | GUCY2C-1476_VL CDR2 | AASKVAP |
| 147 | GUCY2C-1478_VL | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIK |
| 148 | GUCY2C-1478_VL CDR1 | RASESVDYYGSSLLQ |
| 149 | GUCY2C-1478_VL CDR2 | AASKLAS |
| 150 | GUCY2C-1481_VL | DIQLTQSPSSLSASVGDRVTITCRASESVDYYGTSLMQWYQQKPGKAPKLLIYAASNIAPGVPSRFSGSGSGTDFTLTISSLQPEDFATYYCQQTRKAYTFGQGTKLEIK |
| 151 | GUCY2C-1481_VL CDR2 | AASNIAP |
| 152 | GUCY2C-1512_VL | DIQLTQSPSSLSASVGDRVTITCRASESVDYYGSSLMQWYQQKPGKAPKLLIYAASKRYSGVPSRFSGSGSGTDFTLTISSLQPEDFATYYCQQTRKEYTFGQGTKLKIK |
| 153 | GUCY2C-1512_VL CDR1 | RASESVDYYGSSLMQ |
| 154 | GUCY2C-1512_VL CDR3 | QQTRKEYT |
| 155 | GUCY2C-1512_VL FW_L4 | FGQGTKLKIK |
| 156 | GUCY2C-1518_VL | DIQLTQSPSSLSASVGDRVTITCRASESVDYYGSSLMQWYQQKPGKAPKLLIYAASNVAPGVPSRFSGSGSGTDFTLTISSLQPEDFATYYCQQTRKAYTFGQGTKLEIK |
| 157 | GUCY2C-1518_VL CDR2 | AASNVAP |
| 158 | GUCY2C-1526_VL | DIQLTQSPSSLSASVGDRVTITCRASESVDYYGSSLMQWYQQKPGKAPKLLIYAASHRASGVPSRFSGSGSGTDFTLTISSLQPEDFATYYCQQTRKAYTFGQGTKLEIK |
| 159 | GUCY2C-1526_VL CDR2 | AASHRAS |
| 160 | GUCY2C-1527_VL | DIQLTQSPSSLSASVGDRVTITCRASESVDYYGTSLMQWYQQKPGKAPKLLIYAASNVASGVPSRFSGSGSGTDFTLTISSLQPEDFATYYCQQTRKEYTFGQGTKLEIK |
| 161 | GUCY2C-1527_VL CDR2 | AASNVAS |
| 162 | GUCY2C-1538_VL | DIQLTQSPSSLSASVGDRVTITCRASESVDYYGHSLMQWYQQKPGKAPKLLIYAASNRYSGVPSRFSGSGSGTDFTLTISSLQPEDFATYYCQQTRKAYSFGQGTKLEIK |
| 163 | GUCY2C-1538_VL CDR1 | RASESVDYYGHSLMQ |
| 164 | GUCY2C-1538_VL CDR2 | AASNRYS |
| 165 | GUCY2C-1538_VL CDR3 | QQTRKAYS |

TABLE 38-continued

| SEQ ID NO: | Description | Sequence |
|---|---|---|
| 166 | GUCY2C-1554_VL | DIQMTQSPSSLSASVGDRVTITCRASQSVDYYGSSLLQWY QQKPGKAPKLLIYDASKLASGVPSRFSGSGSGTDFTLTISSL QPEDFATYYCQQERKAYTFGQGTKLEIK |
| 167 | GUCY2C-1554_VL CDR1 | RASQSVDYYGSSLLQ |
| 168 | GUCY2C-1554_VL CDR2 | DASKLAS |
| 169 | GUCY2C-1554_VL CDR3 | QQERKAYT |
| 170 | GUCY2C-1555_VL | DIQMTQSPSSLSASVGDRVTITCRASQSVDYYGSSLLQWY QQKPGKAPKLLIYAASKLASGVPSRFSGSGSGTDFTLTISSL QPEDFATYYCQQERKAYTFGQGTKLEIK |
| 171 | GUCY2C-1556_VL | DIQMTQSPSSLSASVGDRVTITCRASQSVDYYGSSLLQWY QQKPGKAPKLLIYDASKLASGVPSRFSGSGSGTDFTLTISSL QPEDFATYYCQQTRKAYTFGQGTKLEIK |
| 172 | GUCY2C-1557_VL | DIQMTQSPSSLSASVGDRVTITCRASQSVDYYGSSLLQWY QQKPGKAPKLLIYAASKLASGVPSRFSGSGSGTDFTLTISSL QPEDFATYYCQQTRKAYTFGQGTKLEIK |
| 173 | GUCY2C-1590_VL | DIQLTQSPSSLSASVGDRVTITCRASESVDYYGSSLLQWYQ QKPGKAPKLLIYDASKLASGVPSRFSGSGSGTDFTLTISSLQ PEDFATYYCQQERKAYTFGQGTKLEIK |
| 174 | GUCY2C-1591_VL | DIQLTQSPSSLSASVGDRVTITCRASESVDYYGSSLLQWYQ QKPGKAPKLLIYAASKLASGVPSRFSGSGSGTDFTLTISSLQ PEDFATYYCQQERKAYTFGQGTKLEIK |
| 175 | GUCY2C-1592_VL | DIQLTQSPSSLSASVGDRVTITCRASESVDYYGSSLLQWYQ QKPGKAPKLLIYDASKLASGVPSRFSGSGSGTDFTLTISSLQ PEDFATYYCQQTRKAYTFGQGTKLEIK |
| 176 | huIGHV3-7_VH | EVQLVESGGGLVQPGGSLRLSCAASGFTFSSYWMSWVRQ APGKGLEWVANIKQDGSEKYYVDSVKGRFTISRDNAKNSL YLQMNSLRAEDTAVYYCARYYYYYGMDV |
| 177 | huIGHV3-7_VH CDR1 | GFTFSSYWMS |
| 178 | huIGHV3-7_VH CDR2 | NIKQDGSEKYYVDSVKG |
| 179 | huIGHV3-7_VH CDR3 | YYYYYGMDV |
| 180 | huIGKV1-39_VL | DIQMTQSPSSLSASVGDRVTITCRASQSISSYLNWYQQKPG KAPKLLIYAASSLQSGVPSRFSGSGSGTDFTLTISSLQPEDF ATYYCQQSYSTPYTFGQGTKLEIK |
| 181 | huIGKV1-39_VL CDR1 | RASQSISSYLN |
| 182 | huIGKV1-39_VL CDR2 | AASSLQS |
| 183 | huIGKV1-39_VL CDR3 | QQSYSTPYT |
| 184 | Human IgG1 CL | RTVAAPSVFIFPPSDEQLKSGTASVVCLLNNFYPREAKVQW KVDNALQSGNSQESVTEQDSKDSTYSLSSTLTLSKADYEK HKVYACEVTHQGLSSPVTKSFNRGEC |
| 185 | Human IgG1 CH1 | ASTKGPSVFPLAPSSKSTSGGTAALGCLVKDYFPEPVTVS WNSGALTSGVHTFPAVLQSSGLYSLSSVVTVPSSSLGTQT YICNVNHKPSNTKVDKKV |
| 186 | Human IgG1 Hinge | EPKSCDKTHTCPPCP |
| 187 | Human IgG1-3m Fc (CH2—CH3) | APEAAGAPSVFLFPPKPKDTLMISRTPEVTCVVVDVSHEDP EVKFNWYVDGVEVHNAKTKPREEQYNSTYRVVSVLTVLHQ |

TABLE 38-continued

| SEQ ID NO: | Description | Sequence |
|---|---|---|
| | | DWLNGKEYKCKVSNKALPAPIEKTISKAKGQPREPQVYTLP PSREEMTKNQVSLTCLVKGFYPSDIAVEWESNGQPENNYK TTPPVLDSDGSFFLYSKLTVDKSRWQQGNVFSCSVMHEAL HNHYTQKSLSLSPGK |
| 188 | Knob Fc chain | APEAAGAPSVFLFPPKPKDTLMISRTPEVTCVVVDVSHEDP EVKFNWYVDGVEVHNAKTKPREEQYNSTYRWSVLTVLHQ DWLNGKEYKCKVSNKALPAPIEKTISKAKGQPREPQVCTLP PSREEMTKNQVSLWCLVKGFYPSDIAVEWESNGQPENNY KTTPPVLDSDGSFFLYSKLTVDKSRWQQGNVFSCSVMHEA LHNHYTQKSLSLSPG |
| 189 | Hole Fc chain | APEAAGAPSVFLFPPKPKDTLMISRTPEVTCVVVDVSHEDP EVKFNWYVDGVEVHNAKTKPREEQYNSTYRWSVLTVLHQ DWLNGKEYKCKVSNKALPAPIEKTISKAKGQPREPQVYTLP PCREEMTKNQVSLSCAVKGFYPSDIAVEWESNGQPENNYK TTPPVLDSDGSFFLVSKLTVDKSRWQQGNVFSCSVMHEAL HNHYTQKSLSLSPG |
| 190 | Linker 1 | GGGSGGGG |
| 191 | Linker 2 | GGGGSGGGG |
| 192 | Linker 3 | GCPPCP |
| 193 | Linker 4 | GGGGSGGGGSGGGGSG |
| 194 | Linker 5 | RTSDQ |
| 195 | Linker 6 | EPKSSDKTHTCPPCP |
| 196 | GUCY2C-0074_Knob | DIVLTQSPASLAVSLGQRATISCRASESVDNYGISFMNWFQ QKPGQPPKLLIYAASNPGSGVPARFSGSGSGTDFSLNIHPL EEDDTAMFFCQQSKEVPYTFGGGTKLEIKGGGSGGGGEV QLVESGGGLVQPGGSLRLSCAASGFTFSDYYMTWVRQAP GKGLEWVAFIRNRARGYTSDHNPSVKGRFTISRDNAKNSL YLQMNSLRAEDTAVYYCARDRPSYYVLDYWGQGTTVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVCTLPPSREEMTKNQVSLWCLVKGFYPSDIAVEWESN GQPENNYKTTPPVLDSDGSFFLYSKLTVDKSRWQQGNVFS CSVMHEALHNHYTQKSLSLSPG |
| 197 | GUCY2C-0074_Hole | DIVMTQSPDSLAVSLGERATINCKSSQSLFNVRSRKNYLAW YQQKPGQPPKLLISWASTRESGVPDRFSGSGSGTDFTLTIS SLQAEDVAVYYCKQSYDLFTFGSGTKLEIKGGGSGGGGEV QLQQSGAELARPGASVNLSCKASGYTFTTYWMQWVKQRP GQGLEWIGAIYPGDGMTTYTQKFKDKATLTADKSSSTAYM QLSSLASEDSAVYYCVRKGMDYWGQGTSVTVSSGCPPCP APEAAGAPSVFLFPPKPKDTLMISRTPEVTCVVVDVSHEDP EVKFNWYVDGVEVHNAKTKPREEQYNSTYRWSVLTVLHQ DWLNGKEYKCKVSNKALPAPIEKTISKAKGQPREPQVYTLP PCREEMTKNQVSLSCAVKGFYPSDIAVEWESNGQPENNYK TTPPVLDSDGSFFLVSKLTVDKSRWQQGNVFSCSVMHEAL HNHYTQKSLSLSPG |
| 198 | GUCY2C-0074_monomer | DIVLTQSPASLAVSLGQRATISCRASESVDNYGISFMNWFQ QKPGQPPKLLIYAASNPGSGVPARFSGSGSGTDFSLNIHPL EEDDTAMFFCQQSKEVPYTFGGGTKLEIKGGGSGGGGEV QLVESGGGLVQPGGSLRLSCAASGFTFSDYYMTWVRQAP GKGLEWVAFIRNRARGYTSDHNPSVKGRFTISRDNAKNSL YLQMNSLRAEDTAVYYCARDRPSYYVLDYWGQGTTVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVCTLPPSREEMTKNQVSLWCLVKGFYPSDIAVEWESN GQPENNYKTTPPVLDSDGSFFLYSKLTVDKSRWQQGNVFS CSVMHEALHNHYTQKSLSLSPGDIVMTQSPDSLAVSLGER ATINCKSSQSLFNVRSRKNYLAWYQQKPGQPPKLLISWAST RESGVPDRFSGSGSGTDFTLTISSLQAEDVAVYYCKQSYDL FTFGSGTKLEIKGGGSGGGGEVQLQQSGAELARPGASVNL SCKASGYTFTTYWMQWVKQRPGQGLEWIGAIYPGDGMTT YTQKFKDKATLTADKSSSTAYMQLSSLASEDSAVYYCVRK GMDYWGQGTSVTVSSGCPPCPAPEAAGAPSVFLFPPKPK DTLMISRTPEVTCVVVDVSHEDPEVKFNWYVDGVEVHNAK TKPREEQYNSTYRWSVLTVLHQDWLNGKEYKCKVSNKAL |

TABLE 38-continued

| SEQ ID NO: | Description | Sequence |
|---|---|---|
| | | PAPIEKTISKAKGQPREPQVYTLPPCREEMTKNQVSLSCAV KGFYPSDIAVEWESNGQPENNYKTTPPVLDSDGSFFLVSKL TVDKSRWQQGNVFSCSVMHEALHNHYTQKSLSLSPG |
| 199 | GUCY2C-0098_Knob | DIVLTQSPASLAVSLGQRATISCRASESVDYYGTSLMQWYQ QKPGQPPKLLIYAASNVESGVPARFSGSGSGTDFSLNIHPV EEDDIAMYFCQQTRKVYTFGGGTKLEIKGGGSGGGGEVQL VESGGGLVQPGGSLRLSCAASGFTFSDYYMTWVRQAPGK GLEWVAFIRNRARGYTSDHNPSVKGRFTISRDNAKNSLYLQ MNSLRAEDTAVYYCARDRPSYYVLDYWGQGTTVTVSSGC PPCPAPEAAGAPSVFLFPPKPKDTLMISRTPEVTCVVVDVS HEDPEVKFNWYVDGVEVHNAKTKPREEQYNSTYRWSVLT VLHQDWLNGKEYKCKVSNKALPAPIEKTISKAKGQPREPQV CTLPPSREEMTKNQVSLWCLVKGFYPSDIAVEWESNGQPE NNYKTTPPVLDSDGSFFLYSKLTVDKSRWQQGNVFSCSVM HEALHNHYTQKSLSLSPG |
| 200 | GUCY2C-0098_Hole | DIVMTQSPDSLAVSLGERATINCKSSQSLFNVRSRKNYLAW YQQKPGQPPKLLISWASTRESGVPDRFSGSGSGTDFTLTIS SLQAEDVAVYYCKQSYDLFTFGSGTKLEIKGGGSGGGGQV QLQQPGAELVKPGASVKLSCKASGYTFTSYWMHWVKQRP GQGLEWIGEIKPSNGLTNYIEKFKNKATLTVDKSATTAYMQL SSLTAEDSAVYYCTRTITTTEGYWFFDVWGAGTTVTVSSG CPPCPAPEAAGAPSVFLFPPKPKDTLMISRTPEVTCVVVDV SHEDPEVKFNWYVDGVEVHNAKTKPREEQYNSTYRWSVL TVLHQDWLNGKEYKCKVSNKALPAPIEKTISKAKGQPREPQ VYTLPPCREEMTKNQVSLSCAVKGFYPSDIAVEWESNGQP ENNYKTTPPVLDSDGSFFLVSKLTVDKSRWQQGNVFSCSV MHEALHNHYTQKSLSLSPG |
| 201 | GUCY2C-0098_monomer | DIVLTQSPASLAVSLGQRATISCRASESVDYYGTSLMQWYQ QKPGQPPKLLIYAASNVESGVPARFSGSGSGTDFSLNIHPV EEDDIAMYFCQQTRKVYTFGGGTKLEIKGGGSGGGGEVQL VESGGGLVQPGGSLRLSCAASGFTFSDYYMTWVRQAPGK GLEWVAFIRNRARGYTSDHNPSVKGRFTISRDNAKNSLYLQ MNSLRAEDTAVYYCARDRPSYYVLDYWGQGTTVTVSSGC PPCPAPEAAGAPSVFLFPPKPKDTLMISRTPEVTCVVVDVS HEDPEVKFNWYVDGVEVHNAKTKPREEQYNSTYRWSVLT VLHQDWLNGKEYKCKVSNKALPAPIEKTISKAKGQPREPQV CTLPPSREEMTKNQVSLWCLVKGFYPSDIAVEWESNGQPE NNYKTTPPVLDSDGSFFLYSKLTVDKSRWQQGNVFSCSVM HEALHNHYTQKSLSLSPGDIVMTQSPDSLAVSLGERATINC KSSQSLFNVRSRKNYLAWYQQKPGQPPKLLISWASTRESG VPDRFSGSGSGTDFTLTISSLQAEDVAVYYCKQSYDLFTFG SGTKLEIKGGGSGGGGQVQLQQPGAELVKPGASVKLSCKA SGYTFTSYWMHWVKQRPGQGLEWIGEIKPSNGLTNYIEKF KNKATLTVDKSATTAYMQLSSLTAEDSAVYYCTRTITTTEGY WFFDVWGAGTTVTVSSGCPPCPAPEAAGAPSVFLFPPKPK DTLMISRTPEVTCVVVDVSHEDPEVKFNWYVDGVEVHNAK TKPREEQYNSTYRWSVLTVLHQDWLNGKEYKCKVSNKAL PAPIEKTISKAKGQPREPQVYTLPPCREEMTKNQVSLSCAV KGFYPSDIAVEWESNGQPENNYKTTPPVLDSDGSFFLVSKL TVDKSRWQQGNVFSCSVMHEALHNHYTQKSLSLSPG |
| 202 | GUCY2C-0105_Knob | DIVMTQSPSSLAVSVGEKVTVSCKSSQSLLYSSNQKNYLA WYQQRPGQSPKLLIYWASTRESGVPDRFTGSGSGTDFTLS ISSVKAEDLAVYYCQQYYSYPTFGGGTKLEIKGGGSGGGG EVQLVESGGGLVQPGGSLRLSCAASGFTFSDYYMTWVRQ APGKGLEWVAFIRNRARGYTSDHNPSVKGRFTISRDNAKN SLYLQMNSLRAEDTAVYYCARDRPSYYVLDYWGQGTTVTV SSGCPPCPAPEAAGAPSVFLFPPKPKDTLMISRTPEVTCVV VDVSHEDPEVKFNWYVDGVEVHNAKTKPREEQYNSTYRV VSVLTVLHQDWLNGKEYKCKVSNKALPAPIEKTISKAKGQP REPQVCTLPPSREEMTKNQVSLWCLVKGFYPSDIAVEWES NGQPENNYKTTPPVLDSDGSFFLYSKLTVDKSRWQQGNVF SCSVMHEALHNHYTQKSLSLSPG |
| 203 | GUCY2C-0105_Hole | DIVMTQSPDSLAVSLGERATINCKSSQSLFNVRSRKNYLAW YQQKPGQPPKLLISWASTRESGVPDRFSGSGSGTDFTLTIS SLQAEDVAVYYCKQSYDLFTFGSGTKLEIKGGGSGGGGEV QLQQSGPELVKPGASVKISCKASGYSFTDYIMLWVKQSHG KSLEWIGNSNPYYGSTSYNLKFKGKATLTVDKSSTAYMHL NSLTSEDSAVYYCARSGYYGSSPYWYFDVWGAGTTVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVYTLPPCREEMTKNQVSLSCAVKGFYPSDIAVEWESN |

TABLE 38-continued

| SEQ ID NO: | Description | Sequence |
|---|---|---|
| | | GQPENNYKTTPPVLDSDGSFFLVSKLTVDKSRWQQGNVFS CSVMHEALHNHYTQKSLSLSPG |
| 204 | GUCY2C-0105_monomer | DIVMTQSPSSLAVSVGEKVTVSCKSSQSLLYSSNQKNYLA WYQQRPGQSPKLLIYWASTRESGVPDRFTGSGSGTDFTLS ISSVKAEDLAVYYCQQYYSYPTFGGGTKLEIKGGGSGGGG EVQLVESGGGLVQPGGSLRLSCAASGFTFSDYYMTWVRQ APGKGLEWVAFIRNRARGYTSDHNPSVKGRFTISRDNAKN SLYLQMNSLRAEDTAVYYCARDRPSYYVLDYWGQGTTVTV SSGCPPCPAPEAAGAPSVFLFPPKPKDTLMISRTPEVTCW VDVSHEDPEVKFNWYVDGVEVHNAKTKPREEQYNSTYRV VSVLTVLHQDWLNGKEYKCKVSNKALPAPIEKTISKAKGQP REPQVCTLPPSREEMTKNQVSLWCLVKGFYPSDIAVEWES NGQPENNYKTTPPVLDSDGSFFLYSKLTVDKSRWQQGNVF SCSVMHEALHNHYTQKSLSLSPGDIVMTQSPDSLAVSLGE RATINCKSSQSLFNVRSRKNYLAWYQQKPGQPPKLLISWA STRESGVPDRFSGSGSGTDFTLTISSLQAEDVAVYYCKQSY DLFTFGSGTKLEIKGGGSGGGGEVQLQQSGPELVKPGASV KISCKASGYSFTDYIMLWVKQSHGKSLEWIGNSNPYYGSTS YNLKFKGKATLTVDKSSSTAYMHLNSLTSEDSAVYYCARSG YYGSSPYWYFDVWGAGTTVTVSSGCPPCPAPEAAGAPSV FLFPPKPKDTLMISRTPEVTCVVVDVSHEDPEVKFNWYVDG VEVHNAKTKPREEQYNSTYRWSVLTVLHQDWLNGKEYKC KVSNKALPAPIEKTISKAKGQPREPQVYTLPPCREEMTKNQ VSLSCAVKGFYPSDIAVEWESNGQPENNYKTTPPVLDSDG SFFLVSKLTVDKSRWQQGNVFSCSVMHEALHNHYTQKSLS LSPG |
| 205 | GUCY2C-0240_Knob | DIQLTQSPSSLSASVGDRVTITCRASESVDNYGISFMNWFQ QKPGKAPKLLIYAASNPGSGVPSRFSGSGSGTDFTLTISSL QPEDFATYYCQQSKEVPYTFGQGTKLEIKGGGSGGGGEV QLVESGGGLVQPGGSLRLSCAASGFTFSDYYMTWVRQAP GKGLEWVAFIRNRARGYTSDHNPSVKGRFTISRDNAKNSL YLQMNSLRAEDTAVYYCARDRPSYYVLDYWGQGTTVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVCTLPPSREEMTKNQVSLWCLVKGFYPSDIAVEWESN GQPENNYKTTPPVLDSDGSFFLYSKLTVDKSRWQQGNVFS CSVMHEALHNHYTQKSLSLSPG |
| 206 | GUCY2C-0240_Hole | DIVMTQSPDSLAVSLGERATINCKSSQSLFNVRSRKNYLAW YQQKPGQPPKLLISWASTRESGVPDRFSGSGSGTDFTLTIS SLQAEDVAVYYCKQSYDLFTFGSGTKLEIKGGGSGGGGEV QLVESGGGLVQPGGSLRLSCAASGYTFTTYWMQWVRQAP GKGLEWIGAIYPGDGMTTYTQKFKDRFTISADKAKNSAYLQ MNSLRAEDTAVYYCVRKGMDYWGQGTLVTVSSGCPPCPA PEAAGAPSVFLFPPKPKDTLMISRTPEVTCWVDVSHEDPE VKFNWYVDGVEVHNAKTKPREEQYNSTYRWSVLTVLHQD WLNGKEYKCKVSNKALPAPIEKTISKAKGQPREPQVYTLPP CREEMTKNQVSLSCAVKGFYPSDIAVEWESNGQPENNYKT TPPVLDSDGSFFLVSKLTVDKSRWQQGNVFSCSVMHEALH NHYTQKSLSLSPG |
| 207 | GUCY2C-0240_monomer | DIQLTQSPSSLSASVGDRVTITCRASESVDNYGISFMNWFQ QKPGKAPKLLIYAASNPGSGVPSRFSGSGSGTDFTLTISSL QPEDFATYYCQQSKEVPYTFGQGTKLEIKGGGSGGGGEV QLVESGGGLVQPGGSLRLSCAASGFTFSDYYMTWVRQAP GKGLEWVAFIRNRARGYTSDHNPSVKGRFTISRDNAKNSL YLQMNSLRAEDTAVYYCARDRPSYYVLDYWGQGTTVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVCTLPPSREEMTKNQVSLWCLVKGFYPSDIAVEWESN GQPENNYKTTPPVLDSDGSFFLYSKLTVDKSRWQQGNVFS CSVMHEALHNHYTQKSLSLSPGDIVMTQSPDSLAVSLGER ATINCKSSQSLFNVRSRKNYLAWYQQKPGQPPKLLISWAST RESGVPDRFSGSGSGTDFTLTISSLQAEDVAVYYCKQSYDL FTFGSGTKLEIKGGGSGGGGEVQLVESGGGLVQPGGSLRL SCAASGYTFTTYWMQWVRQAPGKGLEWIGAIYPGDGMTT YTQKFKDRFTISADKAKNSAYLQMNSLRAEDTAVYYCVRK GMDYWGQGTLVTVSSGCPPCPAPEAAGAPSVFLFPPKPK DTLMISRTPEVTCVVVDVSHEDPEVKFNWYVDGVEVHNAK TKPREEQYNSTYRWSVLTVLHQDWLNGKEYKCKVSNKAL PAPIEKTISKAKGQPREPQVYTLPPCREEMTKNQVSLSCAV KGFYPSDIAVEWESNGQPENNYKTTPPVLDSDGSFFLVSKL TVDKSRWQQGNVFSCSVMHEALHNHYTQKSLSLSPG |

TABLE 38-continued

| SEQ ID NO: | Description | Sequence |
|---|---|---|
| 208 | GUCY2C-0241_light_chain | DIQLTQSPSSLSASVGDRVTITCRASESVDYYGTSLMQWY QQKPGKAPKLLIYAASNVESGVPSRFSGSGSGTDFTLTISS LQPEDFATYYCQQTRKVYTFGQGTKLEIKRTVAAPSVFIFPP SDEQLKSGTASVVCLLNNFYPREAKVQWKVDNALQSGNS QESVTEQDSKDSTYSLSSTLTLSKADYEKHKVYACEVTHQ GLSSPVTKSFNRGEC |
| 209 | GUCY2C-0241_heavy_chain | EVQLVESGGGLVQPGGSLRLSCAASGYTFTSYWMHWVRQ APGKGLEWIGEIKPSNGLTNYIEKFKNRFTISVDKAKNSAYL QMNSLRAEDTAVYYCTRTITTTEGYWFFDVWGQGTLVTVS SASTKGPSVFPLAPSSKSTSGGTAALGCLVKDYFPEPVTVS WNSGALTSGVHTFPAVLQSSGLYSLSSWTVPSSSLGTQT YICNVNHKPSNTKVDKKVEPKSCDKTHTCPPCPAPEAAGA PSVFLFPPKPKDTLMISRTPEVTCVVVDVSHEDPEVKFNWY VDGVEVHNAKTKPREEQYNSTYRWSVLTVLHQDWLNGKE YKCKVSNKALPAPIEKTISKAKGQPREPQVYTLPPSREEMT KNQVSLTCLVKGFYPSDIAVEWESNGQPENNYKTTPPVLD SDGSFFLYSKLTVDKSRWQQGNVFSCSVMHEALHNHYTQ KSLSLSPG |
| 210 | GUCY2C-0247_Knob | DIQLTQSPSSLSASVGDRVTITCRASESVDYYGTSLMQWY QQKPGKPPKLLIYAASNVESGVPSRFSGSGSGTDFTLTISS LQPEDFATYYCQQTRKVYTFGQGTKLEIKGGGSGGGGEV QLVESGGGLVQPGGSLRLSCAASGFTFSDYYMTWVRQAP GKGLEWVAFIRNRARGYTSDHNPSVKGRFTISRDNAKNSL YLQMNSLRAEDTAVYYCARDRPSYYVLDYWGQGTTVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVCTLPPSREEMTKNQVSLWCLVKGFYPSDIAVEWESN GQPENNYKTTPPVLDSDGSFFLYSKLTVDKSRWQQGNVFS CSVMHEALHNHYTQKSLSLSPG |
| 211 | GUCY2C-0247_Hole | DIVMTQSPDSLAVSLGERATINCKSSQSLFNVRSRKNYLAW YQQKPGQPPKLLISWASTRESGVPDRFSGSGSGTDFTLTIS SLQAEDVAVYYCKQSYDLFTFGSGTKLEIKGGGSGGGGEV QLVESGGGLVQPGGSLRLSCAASGYTFTSYWMHWVRQAP GKGLEWIGEIKPSNGLTNYIEKFKNRFTISVDKAKNSAYLQM NSLRAEDTAVYYCTRTITTTEGYWFFDVWGQGTLVTVSSG CPPCPAPEAAGAPSVFLFPPKPKDTLMISRTPEVTCVVVDV SHEDPEVKFNWYVDGVEVHNAKTKPREEQYNSTYRWSVL TVLHQDWLNGKEYKCKVSNKALPAPIEKTISKAKGQPREPQ VYTLPPCREEMTKNQVSLSCAVKGFYPSDIAVEWESNGQP ENNYKTTPPVLDSDGSFFLVSKLTVDKSRWQQGNVFSCSV MHEALHNHYTQKSLSLSPG |
| 212 | GUCY2C-0247_monomer | DIQLTQSPSSLSASVGDRVTITCRASESVDYYGTSLMQWY QQKPGKPPKLLIYAASNVESGVPSRFSGSGSGTDFTLTISS LQPEDFATYYCQQTRKVYTFGQGTKLEIKGGGSGGGGEV QLVESGGGLVQPGGSLRLSCAASGFTFSDYYMTWVRQAP GKGLEWVAFIRNRARGYTSDHNPSVKGRFTISRDNAKNSL YLQMNSLRAEDTAVYYCARDRPSYYVLDYWGQGTTVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVCTLPPSREEMTKNQVSLWCLVKGFYPSDIAVEWESN GQPENNYKTTPPVLDSDGSFFLYSKLTVDKSRWQQGNVFS CSVMHEALHNHYTQKSLSLSPGDIVMTQSPDSLAVSLGER ATINCKSSQSLFNVRSRKNYLAWYQQKPGQPPKLLISWAST RESGVPDRFSGSGSGTDFTLTISSLQAEDVAVYYCKQSYDL FTFGSGTKLEIKGGGSGGGGEVQLVESGGGLVQPGGSLRL SCAASGYTFTSYWMHWVRQAPGKGLEWIGEIKPSNGLTNY IEKFKNRFTISVDKAKNSAYLQMNSLRAEDTAVYYCTRTITT TEGYWFFDVWGQGTLVTVSSGCPPCPAPEAAGAPSVFLF PPKPKDTLMISRTPEVTCVVVDVSHEDPEVKFNWYVDGVE VHNAKTKPREEQYNSTYRWSVLTVLHQDWLNGKEYKCKV SNKALPAPIEKTISKAKGQPREPQVYTLPPCREEMTKNQVS LSCAVKGFYPSDIAVEWESNGQPENNYKTTPPVLDSDGSF FLVSKLTVDKSRWQQGNVFSCSVMHEALHNHYTQKSLSLS PG |
| 213 | GUCY2C-0405_scFv-Fc | EVQLVESGGGLVQPGGSLRLSCAASGYTFTSYWMHWVRQ APGKGLEWIGEIKPSNGLTNVHEKFKNRFTISVDKAKNSAYL QMNSLRAEDTAVYYCTRTITTTEGYWFFDVWGQGTLVTVS SGGGGSGGGGSGGGGSGDIQLTQSPSSLSASVGDRVTIT CRASESVDYYGSSLLQWYQQKPGKAPKLLIYAASKLASGV |

TABLE 38-continued

| SEQ ID NO: | Description | Sequence |
|---|---|---|
| | | PSRFSGSGSGTDFTLTISSLQPEDFATYYCQQTRKAYTFGQ GTKLEIKRTSDQEPKSSDKTHTCPPCPAPEAAGAPSVFLFP PKPKDTLMISRTPEVTCVVVDVSHEDPEVKFNWYVDGVEV HNAKTKPREEQYNSTYRWSVLTVLHQDWLNGKEYKCKVS NKALPAPIEKTISKAKGQPREPQVYTLPPSREEMTKNQVSL TCLVKGFYPSDIAVEWESNGQPENNYKTTPPVLDSDGSFFL YSKLTVDKSRWQQGNVFSCSVMHEALHNHYTQKSLSLSP |
| 214 | GUCY2C-0486_light_chain; GUCY2C-1640_light_chain | DIQLTQSPSSLSASVGDRVTITCRASESVDYYGSSLLQWYQ QKPGKAPKLLIYAASKLASGVPSRFSGSGSGTDFTLTISSLQ PEDFATYYCQQTRKAYTFGQGTKLEIKRTVAAPSVFIFPPS DEQLKSGTASWCLLNNFYPREAKVQWKVDNALQSGNSQ ESVTEQDSKDSTYSLSSTLTLSKADYEKHKVYACEVTHQGL SSPVTKSFNRGEC |
| 215 | GUCY2C-0486_heavy_chain | EVQLVESGGGLVQPGGSLRLSCAASGYTFTSYWMHWVRQ APGKGLEWIGEIKPSNGLTNVHEKFKNRFTISVDKAKNSAYL QMNSLRAEDTAVYYCTRTITTTEGYWFFDVWGQGTLVTVS SASTKGPSVFPLAPSSKSTSGGTAALGCLVKDYFPEPVTVS WNSGALTSGVHTFPAVLQSSGLYSLSSWTVPSSSLGTQT YICNVNHKPSNTKVDKKVEPKSCDKTHTCPPCPAPEAAGA PSVFLFPPKPKDTLMISRTPEVTCVVVDVSHEDPEVKFNWY VDGVEVHNAKTKPREEQYNSTYRWSVLTVLHQDWLNGKE YKCKVSNKALPAPIEKTISKAKGQPREPQVYTLPPSREEMT KNQVSLTCLVKGFYPSDIAVEWESNGQPENNYKTTPPVLD SDGSFFLYSKLTVDKSRWQQGNVFSCSVMHEALHNHYTQ KSLSLSPG |
| 216 | GUCY2C-1478_Knob; GUCY2C-1608_Knob | DIQLTQSPSSLSASVGDRVTITCRASESVDYYGSSLLQWYQ QKPGKAPKLLIYAASKLASGVPSRFSGSGSGTDFTLTISSLQ PEDFATYYCQQTRKAYTFGQGTKLEIKGGGSGGGGEVQLV ESGGGLVQPGGSLRLSCAASGFTFSDYYMTWVRQAPGKG LEWVAFIRNQARGYTSDHNPSVKGRFTISRDNAKNSLYLQ MNSLRAEDTAVYYCARDRPSYYVLDYWGQGTTVTVSSGC PPCPAPEAAGAPSVFLFPPKPKDTLMISRTPEVTCVVVDVS HEDPEVKFNWYVDGVEVHNAKTKPREEQYNSTYRWSVLT VLHQDWLNGKEYKCKVSNKALPAPIEKTISKAKGQPREPQV CTLPPSREEMTKNQVSLWCLVKGFYPSDIAVEWESNGQPE NNYKTTPPVLDSDGSFFLYSKLTVDKSRWQQGNVFSCSVM HEALHNHYTQKSLSLSPG |
| 217 | GUCY2C-1478_Hole | DIQMTQSPSSLSASVGDRVTITCTSSQSLFNVRSQKNYLAW YQQKPGKAPKLLIYWASTRESGVPSRFSGSGSGTDFTLTIS SLQPEDFATYYCKQSYDLFTFGGGTKVEIKGGGGSGGGGE VQLVESGGGLVQPGGSLRLSCAASGYTFTSYWMHWVRQA PGKGLEWIGEIKPSNGLTNVHEKFKNRFTISVDKAKNSAYL QMNSLRAEDTAVYYCTRTITTTEGYWFFDVWGQGTLVTVS SGCPPCPAPEAAGAPSVFLFPPKPKDTLMISRTPEVTCVVV DVSHEDPEVKFNWYVDGVEVHNAKTKPREEQYNSTYRW SVLTVLHQDWLNGKEYKCKVSNKALPAPIEKTISKAKGQPR EPQVYTLPPCREEMTKNQVSLSCAVKGFYPSDIAVEWESN GQPENNYKTTPPVLDSDGSFFLVSKLTVDKSRWQQGNVFS CSVMHEALHNHYTQKSLSLSPG |
| 218 | GUCY2C-1478_monomer | DIQLTQSPSSLSASVGDRVTITCRASESVDYYGSSLLQWYQ QKPGKAPKLLIYAASKLASGVPSRFSGSGSGTDFTLTISSLQ PEDFATYYCQQTRKAYTFGQGTKLEIKGGGSGGGGEVQLV ESGGGLVQPGGSLRLSCAASGFTFSDYYMTWVRQAPGKG LEWVAFIRNQARGYTSDHNPSVKGRFTISRDNAKNSLYLQ MNSLRAEDTAVYYCARDRPSYYVLDYWGQGTTVTVSSGC PPCPAPEAAGAPSVFLFPPKPKDTLMISRTPEVTCVVVDVS HEDPEVKFNWYVDGVEVHNAKTKPREEQYNSTYRWSVLT VLHQDWLNGKEYKCKVSNKALPAPIEKTISKAKGQPREPQV CTLPPSREEMTKNQVSLWCLVKGFYPSDIAVEWESNGQPE NNYKTTPPVLDSDGSFFLYSKLTVDKSRWQQGNVFSCSVM HEALHNHYTQKSLSLSPGDIQMTQSPSSLSASVGDRVTITC TSSQSLFNVRSQKNYLAWYQQKPGKAPKLLIYWASTRESG VPSRFSGSGSGTDFTLTISSLQPEDFATYYCKQSYDLFTFG GGTKVEIKGGGGSGGGGEVQLVESGGGLVQPGGSLRLSC AASGYTFTSYWMHWVRQAPGKGLEWIGEIKPSNGLTNVHE KFKNRFTISVDKAKNSAYLQMNSLRAEDTAVYYCTRTITTTE GYWFFDVWGQGTLVTVSSGCPPCPAPEAAGAPSVFLFPP KPKDTLMISRTPEVTCVVVDVSHEDPEVKFNWYVDGVEVH NAKTKPREEQYNSTYRWSVLTVLHQDWLNGKEYKCKVSN KALPAPIEKTISKAKGQPREPQVYTLPPCREEMTKNQVSLS CAVKGFYPSDIAVEWESNGQPENNYKTTPPVLDSDGSFFL VSKLTVDKSRWQQGNVFSCSVMHEALHNHYTQKSLSLSPG |

TABLE 38-continued

| SEQ ID NO: | Description | Sequence |
|---|---|---|
| 219 | Human IgG1 Upper Hinge | EPKSCDKTHT |
| 220 | GUCY2C-1608_Hole | DIQMTQSPSSLSASVGDRVTITCTSSQSLFNVRSQKNYLAW YQQKPGKAPKLLIYWASTRESGVPSRFSGSGSGTDFTLTIS SLQPEDFATYYCKQSYDLFTFGGGTKVEIKGGGGSGGGGE VQLVESGGGLVQPGGSLRLSCAASGFTFSSYWMHWVRQA PGKGLEWIGEIKPSNELTNVHEKFKDRFTISVDKAKNSAYLQ MNSLRAEDTAVYYCTRTITTTEGYWFFDVWGQGTLVTVSS GCPPCPAPEAAGAPSVFLFPPKPKDTLMISRTPEVTCVVVD VSHEDPEVKFNWYVDGVEVHNAKTKPREEQYNSTYRWS VLTVLHQDWLNGKEYKCKVSNKALPAPIEKTISKAKGQPRE PQVYTLPPCREEMTKNQVSLSCAVKGFYPSDIAVEWESNG QPENNYKTTPPVLDSDGSFFLVSKLTVDKSRWQQGNVFSC SVMHEALHNHYTQKSLSLSPG |
| 221 | GUCY2C-1608_monomer | DIQLTQSPSSLSASVGDRVTITCRASESVDYYGSSLLQWYQ QKPGKAPKLLIYAASKLASGVPSRFSGSGSGTDFTLTISSLQ PEDFATYYCQQTRKAYTFGQGTKLEIKGGGSGGGGEVQLV ESGGGLVQPGGSLRLSCAASGFTFSDYYMTWVRQAPGKG LEWVAFIRNQARGYTSDHNPSVKGRFTISRDNAKNSLYLQ MNSLRAEDTAVYYCARDRPSYYVLDYWGQGTTVTVSSGC PPCPAPEAAGAPSVFLFPPKPKDTLMISRTPEVTCVVVDVS HEDPEVKFNWYVDGVEVHNAKTKPREEQYNSTYRWSVLT VLHQDWLNGKEYKCKVSNKALPAPIEKTISKAKGQPREPQV CTLPPSREEMTKNQVSLWCLVKGFYPSDIAVEWESNGQPE NNYKTTPPVLDSDGSFFLYSKLTVDKSRWQQGNVFSCSVM HEALHNHYTQKSLSLSPGDIQMTQSPSSLSASVGDRVTITC TSSQSLFNVRSQKNYLAWYQQKPGKAPKLLIYWASTRESG VPSRFSGSGSGTDFTLTISSLQPEDFATYYCKQSYDLFTFG GGTKVEIKGGGGSGGGGEVQLVESGGGLVQPGGSLRLSC AASGFTFSSYWMHWVRQAPGKGLEWIGEIKPSNELTNVHE KFKDRFTISVDKAKNSAYLQMNSLRAEDTAVYYCTRTITTTE GYWFFDVWGQGTLVTVSSGCPPCPAPEAAGAPSVFLFPP KPKDTLMISRTPEVTCVVVDVSHEDPEVKFNWYVDGVEVH NAKTKPREEQYNSTYRWSVLTVLHQDWLNGKEYKCKVSN KALPAPIEKTISKAKGQPREPQVYTLPPCREEMTKNQVSLS CAVKGFYPSDIAVEWESNGQPENNYKTTPPVLDSDGSFFL VSKLTVDKSRWQQGNVFSCSVMHEALHNHYTQKSLSLSPG |
| 222 | Human IgG1 Lower Hinge Region | CPPCP |
| 223 | GUCY2C-1640_heavy_chain | EVQLVESGGGLVQPGGSLRLSCAASGFTFSSYWMHWVRQ APGKGLEWIGEIKPSNELTNVHEKFKDRFTISVDKAKNSAYL QMNSLRAEDTAVYYCTRTITTTEGYWFFDVWGQGTLVTVS SASTKGPSVFPLAPSSKSTSGGTAALGCLVKDYFPEPVTVS WNSGALTSGVHTFPAVLQSSGLYSLSSWTVPSSSLGTQT YICNVNHKPSNTKVDKKVEPKSCDKTHTCPPCPAPEAAGA PSVFLFPPKPKDTLMISRTPEVTCVVVDVSHEDPEVKFNWY VDGVEVHNAKTKPREEQYNSTYRWSVLTVLHQDWLNGKE YKCKVSNKALPAPIEKTISKAKGQPREPQVYTLPPSREEMT KNQVSLTCLVKGFYPSDIAVEWESNGQPENNYKTTPPVLD SDGSFFLYSKLTVDKSRWQQGNVFSCSVMHEALHNHYTQ KSLSLSPG |
| 224 | Human GUCY2C full length | SQVSQNCHNGSYEISVLMMGNSAFAEPLKNLEDAVNEGLEI VRGRLQNAGLNVTVNATFMYSDGLIHNSGDCRSSTCEGLD LLRKISNAQRMGCVLIGPSCTYSTFQMYLDTELSYPMISAG SFGLSCDYKETLTRLMSPARKLMYFLVNFWKTNDLPFKTYS WSTSYVYKNGTETEDCFWYLNALEASVSYFSHELGFKWL RQDKEFQDILMDHNRKSNVIIMCGGPEFLYKLKGDRAVAED IVIILVDLFNDQYLEDNVTAPDYMKNVLVLTLSPGNSLLNSSF SRNLSPTKRDFALAYLNGILLFGHMLKIFLENGENITTPKFAH AFRNLTFEGYDGPVTLDDWGDVDSTMVLLYTSVDTKKYKV LLTYDTHVNKTYPVDMSPTFTWKNSKLPNDITGRGPQILMIA VFTLTGAWLLLLVALLMLRKYRKDYELRQKKWSHIPPENIF PLETNETNHVSLKIDDDKRRDTIQRLRQCKYDKKRVILKDLK HNDGNFTEKQKIELNKLLQIDYYNLTKFYGTVKLDTMIFGVIE YCERGSLREVLNDTISYPDGTFMDWEFKISVLYDIAKGMSY LHSSKTEVHGRLKSTNCWDSRMWKITDFGCNSILPPKKD LWTAPEHLRQANISQKGDVYSYGIIAQEIILRKETFYTLSCRD RNEKIFRVENSNGMKPFRPDLFLETAEEKELEVYLLVKNCW EEDPEKRPDFKKIETTLAKIFGLFHDQKNESYMDTLIRRLQL YSRNLEHLVEERTQLYKAERDRADRLNFMLLPRLWKSLKE |

TABLE 38-continued

| SEQ ID NO: | Description | Sequence |
|---|---|---|
| | | KGFVEPELYEEVTIYFSDIVGFTTICKYSTPMEWDMLNDIYK SFDHIVDHHDVYKVETIGDAYMVASGLPKRNGNRHAIDIAK MALEILSFMGTFELEHLPGLPIWIRIGVHSGPCAAGWGIKM PRYCLFGDTVNTASRMESTGLPLRIHVSGSTIAILKRTECQF LYEVRGETYLKGRGNETTYWLTGMKDQKFNLPTPPTVENQ QRLQAEFSDMIANSLQKRQAAGIRSQKPRRVASYKKGTLE YLQLNTTDKESTYFTRTRPLEQKLISEEDLAANDILDYKDDD DK |
| 225 | Human GUCY2C full length | TCCCAGGTGAGTCAGAACTGCCACAATGGCAGCTATGAA ATCAGCGTCCTGATGATGGGCAACTCAGCCTTTGCAGAG CCCCTGAAAAACTTGGAAGATGCGGTGAATGAGGGGCT GGAAATAGTGAGAGGACGTCTGCAAAATGCTGGCCTAAA TGTGACTGTGAACGCTACTTTCATGTATTCGGATGGTCT GATTCATAACTCAGGCGACTGCCGGAGTAGCACCTGTGA AGGCCTCGACCTACTCAGGAAAATTTCAAATGCACAACG GATGGGCTGTGTCCTCATAGGGCCCTCATGTACATACTC CACCTTCCAGATGTACCTTGACACAGAATTGAGCTACCC CATGATCTCAGCTGGAAGTTTTGGATTGTCATGTGACTAT AAAGAAACCTTAACCAGGCTGATGTCTCCAGCTAGAAAG TTGATGTACTTCTTGGTTAACTTTTGGAAAACCAACGATC TGCCCTTCAAAACTTATTCCTGGAGCACTTCGTATGTTTA CAAGAATGGTACAGAAACTGAGGACTGTTTCTGGTACCT TAATGCTCTGGAGGCTAGCGTTTCCTATTTCTCCCACGA ACTCGGCTTTAAGGTGGTGTTAAGACAAGATAAGGAGTT TCAGGATATCTTAATGGACCACAACAGGAAAAGCAATGT GATTATTATGTGTGGTGGTCCAGAGTTCCTCTACAAGCT GAAGGGTGACCGAGCAGTGGCTGAAGACATTGTCATTAT TCTAGTGGATCTTTTCAATGACCAGTACTTGGAGGACAAT GTCACAGCCCCTGACTATATGAAAAATGTCCTTGTTCTGA CGCTGTCTCCTGGGAATTCCCTTCTAAATAGCTCTTTCTC CAGGAATCTATCACCAACAAAACGAGACTTTGCTCTTGC CTATTTGAATGGAATCCTGCTCTTTGGACATATGCTGAAG ATATTCTTGAAAATGGAGAAAATATTACCACCCCCAAAT TTGCTCATGCTTTCAGGAATCTCACTTTTGAAGGGTATGA CGGTCCAGTGACCTTGGATGACTGGGGGGATGTTGACA GTACCATGGTGCTTCTGTATACCTCTGTGGACACCAAGA AATACAAGGTTCTTTTGACCTATGATACCCACGTAAATAA GACCTATCCTGTGGATATGAGCCCCACATTCACTTGGAA GAACTCTAAACTTCCTAATGATATTACAGGCCGGGGCCC TCAGATCCTGATGATTGCAGTCTTCACCCTCACTGGAGC TGTGGTGCTGCTCCTGCTCGTCGCTCTCCTGATGCTCAG AAAATATAGAAAAGATTATGAACTTCGTCAGAAAAAATGG TCCCACATTCCTCCTGAAAATATCTTTCCTCTGGAGACCA ATGAGACCAATCATGTTAGCCTCAAGATCGATGATGACA AAAGACGAGATACAATCCAGAGACTACGACAGTGCAAAT ACGACAAAAAGCGAGTGATTCTCAAAGATCTCAAGCACA ATGATGGTAATTTCACTGAAAAACAGAAGATAGAATTGAA CAAGTTGCTTCAGATTGACTATTACAACCTGACCAAGTTC TACGGCACAGTGAAACTTGATACCATGATCTTCGGGGTG ATAGAATACTGTGAGAGAGGATCCCTCCGGGAAGTTTTA AATGACACAATTTCCTACCCTGATGGCACATTCATGGATT GGGAGTTTAAGATCTCTGTCTTGTATGACATTGCTAAGG GAATGTCATATCTGCACTCCAGTAAGACAGAAGTCCATG GTCGTCTGAAATCTACCAACTGCGTAGTGGACAGTAGAA TGGTGGTGAAGATCACTGATTTTGGCTGCAATTCCATTTT ACCTCCAAAAAAGGACCTGTGGACAGCTCCAGAGCACCT CCGCCAAGCCAACATCTCTCAGAAAGGAGATGTGTACAG CTATGGGATCATCGCACAGGAGATCATTCTGCGGAAAGA AACCTTCTACACTTTGAGCTGTCGGGACCGGAATGAGAA GATTTTCAGAGTGGAAAATTCCAATGGAATGAAACCCTTC CGCCCAGATTTATTCTTGGAAACAGCAGAGGAAAAAGAG CTAGAAGTGTACCTACTTGTAAAAAACTGTTGGGAGGAA GATCCAGAAAAGAGACCAGATTTCAAAAAAATTGAGACTA CACTTGCCAAGATATTTGGACTTTTTCATGACCAAAAAAA TGAAAGCTATATGGATACCTTGATCCGACGTCTACAGCT ATATTCTCGAAACCTGGAACATCTGGTAGAGGAAAGGAC ACAGCTGTACAAGGCAGAGAGGGACAGGGCTGACAGAC TTAACTTTATGTTGCTTCCAAGGCTAGTGGTAAAGTCTCT GAAGGAGAAAGGCTTTGTGGAGCCGGAACTATATGAGG AAGTTACAATCTACTTCAGTGACATTGTAGTTTCACTAC TATCTGCAAATACAGCACCCCCATGGAAGTGGTGGACAT GCTTAATGACATCTATAAGAGTTTTGACCACATTGTTGAT CATCATGATGTCTACAAGGTGGAAACCATCGGTGATGCG TACATGGTGGCTAGTGGTTTGCCTAAGAGAAATGGCAAT CGGCATGCAATAGACATTGCCAAGATGGCCTTGGAAATC CTCAGCTTCATGGGGACCTTTGAGCTGGAGCATCTTCCT |

TABLE 38-continued

| SEQ ID NO: | Description | Sequence |
|---|---|---|
| | | GGCCTCCCAATATGGATTCGCATTGGAGTTCACTCTGGT<br>CCCTGTGCTGCTGGAGTTGTGGGAATCAAGATGCCTCGT<br>TATTGTCTATTTGGAGATACGGTCAACACAGCCTCTAGG<br>ATGGAATCCACTGGCCTCCCTTTGAGAATTCACGTGAGT<br>GGCTCCACCATAGCCATCCTGAAGAGAACTGAGTGCCA<br>GTTCCTTTATGAAGTGAGAGGAGAAACATACTTAAAGGG<br>AAGAGGAAATGAGACTACCTACTGGCTGACTGGGATGAA<br>GGACCAGAAATTCAACCTGCCAACCCCTCCTACTGTGGA<br>GAATCAACAGCGTTTGCAAGCAGAATTTTCAGACATGATT<br>GCCAACTCTTTACAGAAAAGACAGGCAGCAGGGATAAGA<br>AGCCAAAAACCCAGACGGGTAGCCAGCTATAAAAAAGGC<br>ACTCTGGAATACTTGCAGCTGAATACCACAGACAAGGAG<br>AGCACCTATTTTACGCGTACGCGGCCGCTCGAGCAGAAA<br>CTCATCTCAGAAGAGGATCTGGCAGCAAATGATATCCTG<br>GATTACAAGGATGACGACGATAAG |
| 226 | Cynomolgus GUCY2C full length | SQVSQNCHNGSYEISVLMMDNSAFAEPLENVEDAVNEGLE<br>IVRGRLQNAGLNVTVNASFMYSDGLIHNSGDCRSSTCEGL<br>DLLRKISNAKRMGCVLMGPSCTYSTFQMYLDTELSYPMISA<br>GSFGLSCDYKETLTRLMSPARKLTYFLVNFWKTNDLPFKTY<br>SWSTSYVYKNGTESEDCFWYLNALEASVSYFSHELSFKLV<br>LRQDKEFQDILMDHNRKSNVIVMCGDPEFLYKLKGDRAVA<br>EDIVIILVDLFNDQYFEDNVTAPDYMKNVLVLTQSPGNSLLN<br>SSFSRNLSPTKRDFALAYLNGILLFGHMLKTFLENGENITTP<br>KFAHAFRNLTFEGYDGPVTLDDWGDVDSTMVLLYTSVDTK<br>KYKVLLTYDTHVNQTNPVDMSPTFTWKNSKLPNDITDRGP<br>QILMIAVFTLTGAWLLLLVALLMLRKYKKDYELRQKKWSHIP<br>PENIFPLETNETNHVSLKIDDDKRRDTIQRLRQCKYDKKRVI<br>LKDLKHNDGNFTEKQKIELNKLLQIDYYNLTKFYGTVKLDTM<br>IFGVIEYCERGSLREVLNDTISYPDGTFMDWEFKISVLYDIAK<br>GMSYLHSSKTEVHGRLKSTNCWDSRMWKITDFGCNSILP<br>PKKDLWTAPEHLRQANVSQKGDVYSYGIIAQEIILRKETFYT<br>SSCRDRNEKIFRVENSNGMKPFRPDLFLETAEEKELEVYLL<br>VKSCWEEDPEKRPDFKKIETTLAKIFGLFHDQKNESYMDTLI<br>RRLQLYSRNLEHLVEERTQLYKAERDRADRLNFMLLPRLW<br>KSLKEKGFVEPELYEEVTIYFSDIVGFTTICKYSTPMEWDM<br>LNDIYKSFDHIVDHHDVYKVETIGDAYMVASGLPKRNGNRH<br>AIDIAKMALEILSFMGTFELEHLPGLPIWIRIGVHSGPCAAGV<br>VGIKMPRYCLFGDTVNTASRMESTGLPLRIHVSGSTIAILKR<br>TECQFLYEVRGETYLKRGNETTYWLTGMKDQKFNLPTPP<br>TVENQQRLQAEFSDMIANSLQKRQAAGIRSQKPRRVASYK<br>KGTLEYLQLNTTDKESTYFTRTRPLEQKLISEEDLAANDILD<br>YKDDDDK |
| 227 | Cynomolgus GUCY2C full length | tcacaggtgagtcagaactgccacaatggcagctatgaaatcagcgtcctgatgat<br>ggacaactcagcctttgcagagcccctggaaaacgtggaagatgcggtgaatgag<br>gggctgaaatagtgagaggacgtctgcaaaacgctggcctaaatgtgactgtga<br>atgcttctttcatgtattcggatggtctgattcataactccggcgactgccggagcagc<br>acctgtgaaggccttgacctactcaggaaaatttcaaatgcaaaacggatgggctgt<br>gtcctcatggggccctcatgtacatactccaccttccagatgtaccttgacacagaatt<br>gagctaccccatgatctcagctggaagttttggattgtcatgtgactataaagaaacct<br>taaccaggctgatgtctccagctagaaagttgacatacttcttggttaacttttggaaa<br>accaatgatctaccctttcaaaacttattcctggagcacttcgtatgtttacaagaatggt<br>acggagtccgaggactgtttctggtaccttaacgctctggaggcagtgtttcctatttc<br>tcccacgaactcagttttaagttggtgttaagacaagataaggagtttcaggatatctt<br>aatgaccacaacaggaaaagcaatgtgattgcttatgtgtggtgatccaGagttcct<br>ctacaagttgaagggtgaccgagcagtggctgaagacattgtcattattctagtggat<br>cttttcaatgaccagtactttgaggacaatgtcacagcccctgactatatgaaaaatgt<br>ccttgttctgacgcagtctcctggcaatttcctcctaaatagctctttctccaggaatcta<br>tccccaacaaaacgagactttgctcttgcctatttgaatggaatcctgctctttggacat<br>atgctaaagacatttcttgaaaatggagaaaatattaccaccccaaatttgctcatg<br>ctttcaggaatctcacttttgaagggtatgacggtccagtgaccttggatgactgggg<br>ggatgtggacagtaccatggtgcttctgtatacgtctgtggacaccaagaaataacaa<br>ggttcttttgacctatgatacccacgtaaatcagaccaaccctgtggatatgagcccc<br>acattcacttggaagaactctaaacttcctaatgatattacagaccggggccctcag<br>atcctgatgattgcagtcttcacccctcaccggagctgtggtgctgctcctgcttgtcgct<br>ctcctgatgctcagaaaatataaaaagattatgaacttcgtcagaaaaatggtcc<br>cacattcctcctgaaaatatctttcctctggagaccaatgagaccaatcacgttagcct<br>gaagatcgatgatgacaaaagacgagatacaatccagagactacgacagtgca<br>aatacgacaaaaagcgagtgattctcaaagatctcaagcacaatgatggtaatttc<br>actgaaaaacagaagatagaattgaacaagttgcttcagattgactattacaacctg<br>accaagttctatggcaccgtgaaacttgataccatgatctttcggggtgatagaatact<br>gtgagagaggatccctccgggaagttttaaatgacacaatttcctaccctgatggca<br>cattcatggattgggagtttaagatctctgtcctgtatgacattgctaagggaatgtcat<br>atctgcactccagtaagacagaagtccatggtcgtctgaaatctaccaactgcgtag<br>tggacagtagaatggtggtgaagatcactgattttggctgcaattccatttttacctcca<br>aaaaaagacctgtggacagctccagagcacctccgccaagccaacgtctctcag TABLE 38-continued

| SEQ ID NO: | Description | Sequence |
|---|---|---|
| | | aaaggagatgtgtacagctacgggatcatcgcacaggagatcatcctgcggaaa<br>gaaaccttctacacttcgagctgtcgagaccggaacgagaagattttcagagtgga<br>aaattccaatggaatgaaaccttccgtccagatttattcttggaaacggcagagga<br>aaaagagctagaagtgtacctacttgtaaaaagctgttgggaagaagatccagaa<br>aagagaccagatttcaaaaaaattgagactacacttgccaagatatttggacttttc<br>atgaccaaaaaaatgaaagctatatggataccttgatccgacgtctacagctatattc<br>tcgaaacctggaacatctggtagaggaaaggacacagctatacaaggcagaga<br>gggacagggctgacagacttaactttatgttgcttccaaggctagtggtaaagtctct<br>gaaggagaaaggctttgtagagccggaactatatgaggaagttacaatctacttca<br>gtgacattgtaggtttcactactatctgcaaatacagcaccccatggaagtggtgga<br>catgcttaatgacatctataagagttttgaccacattgttgatcatcatgatgtctacaa<br>ggtgaaaccattggtgatgcctacatggtggctagtggtttgcctaagagaaatgg<br>caatcggcatgcaatagacattgccaagatggccttggaaatcctcagcttcatggg<br>gacctttgagctggagcatcttcctggcctcccaatatggattcgcattggcgttcactc<br>tggtccctgcgctgctggagttgtgggaatcaagatgcctcgttattgtctatttggaga<br>tacagtcaacacagcctctaggatggaatccactggcctcccttgaggattcatgtg<br>agtggctccaccatagccattctgaagagaactgagtgccagttcctgtatgaagtg<br>agaggagaaacgtacttaaagggaagaggaaatgagactacctactggctgacc<br>gggatgaaggaccagaaattcaacctgccaacccctcctactgtggagaatcaac<br>agcgtttgcaagcagaattttcagacatgattgccaactctttacagaaaagacagg<br>cggcagggataagaagccaaaaacccagacgagtagccagctataaaaaagg<br>cactctggaatacttgcaactgaataccacggacaaggagagcacctatttttACG<br>CGTACTCGGCCGCTCGAGCAGAAACTCATCTCAGAAGA<br>GGATCTGGCAGCAAATGATATCCTGGATTACAAGGATGA<br>CGACGATAAG |
| 228 | Murine GUCY2C full length | VFWASQVRQNCRNGSYEISVLMMDNSAYKEPMQNLREAV<br>EEGLDIVRKRLREADLNVTVNATFIYSDGLIHKSGDCRSSTC<br>EGLDLLREITRDHKMGCALMGPSCTYSTFQMYLDTELNYP<br>MISAGSYGLSCDYKETLTRILPPARKLMYFLVDFWKVNNAS<br>FKPFSWNSSYVYKNGSEPEDCFWYLNALEAGVSYFSEVLN<br>FKDVLRRSEQFQEILTGHNRKSNVIVMCGTPESFYDVKGDL<br>QVAEDTWILVDLFSNHYFEENTTAPEYMDNVLVLTLPSEQ<br>STSNTSVAERFSSGRSDFSLAYLEGTLLFGHMLQTFLENGE<br>NVTGPKFARAFRNLTFQGFAGPVTLDDSGDIDNIMSLLYVS<br>LDTRKYKVLMKYDTHKNKTIPVAENPNFIWKNHKLPNDVPG<br>LGPQILMIAVFTLTGILWLLLIALLVLRKYRRDHALRQKKWS<br>HIPSENIFPLETNETNHISLKIDDDRRRDTIQRVRQCKYDKKK<br>VILKDLKHSDGNFSEKQKIDLNKLLQSDYYNLTKFYGTVKLD<br>TRIFGWEYCERGSLREVLNDTISYPDGTFMDWEFKISVLN<br>DIAKGMSYLHSSKIEVHGRLKSTNCWDSRMWKITDFGCN<br>SILPPKKDLWTAPEHLRQATISQKGDVYSFAIIAQEIILRKETF<br>YTLSCRDHNEKIFRVENSYGKPFRPDLFLETADEKELEVYLL<br>VKSCWEEDPEKRPDFKKIESTLAKIFGLFHDQKNESYMDTLI<br>RRLQLYSRNLEHLVEERTQLYKAERDRADHLNFMLLPRLW<br>KSLKEKGIVEPELYEEVTIYFSDIVGFTTICKYSTPMEWDML<br>NDIYKSFDQIVDHHDVYKVETIGDAYWASGLPMRNGNRHA<br>VDISKMALDILSFIGTFELEHLPGLPVWIRIGVHSGPCAAGW<br>GIKMPRYCLFGDTVNTASRMESTGLPLRIHMSSSTITILKRT<br>DCQFLYEVRGETYLKGRGTETTYWLTGMKDQEYNLPSPPT<br>VENQQRLQTEFSDMIVSALQKRQASGKKSRRPTRVASYKK<br>GFLEYMQLNNSDHDSTYFTRTRPLEQKLISEEDLAANDILDY<br>KDDDDK |
| 229 | Murine GUCY2C full length | GTGTTCTGGGCCTCTCAGGTGAGGCAGAACTGCCGCAA<br>TGGCAGCTACGAGATCAGCGTCCTGATGATGGACAACTC<br>AGCCTACAAAGAACCTATGCAAAACCTGAGGGAGGCTGT<br>GGAGGAAGGACTGGACATAGTGCGAAAGCGCCTGCGTG<br>AAGCCGACCTAAATGTGACTGTGAACGCGACTTTCATCT<br>ACTCCGACGGTCTGATTCATAAGTCAGGTGACTGCCGGA<br>GCAGCACCTGTGAAGGCCTTGACCTACTCAGGGAGATTA<br>CAAGAGATCATAAGATGGGCTGCGCCCTCATGGGGCCC<br>TCGTGCACGTATTCCACCTTCCAGATGTACCTCGACACA<br>GAGTTGAACTATCCCATGTTTCCGCTGGAAGTTATGGA<br>TTGTCCTGTGACTATAAGGAAACCCTAACCAGGATCCTG<br>CCTCCAGCCAGGAAGCTGATGTACTTCTTGGTCGATTTC<br>TGGAAAGTCAACAATGCATCTTTCAAACCCTTTTCCTGGA<br>ACTCTTCGTATGTTTACAAGAATGGATCGGAACCTGAAG<br>ATTGTTTCTGGTACCTCAATGCTCTGGAGGCTGGGGTGT<br>CCTATTTTCTGAGGTGCTCAACTTCAAGGATGTACTGAG<br>ACGCAGCGAACAGTTCCAGGAAATCTTAACAGGCCATAA<br>CAGAAAGAGCAATGTGATTGTTATGTGGCACGCCGAA<br>AAGCTTCTATGATGTGAAAGGTGACCTCCAAGTGGCTGA<br>AGATACTGTTGTCATCCTGGTAGATCTGTTCAGTAACCAT<br>TACTTTGAGGAGAACACCACAGCTCCTGAGTATATGGAC<br>AATGTCCTCGTCCTGACGCTGCCGTCTGAACAGTCCACC<br>TCAAACACCTCTGTCGCCGAGAGGTTTTCATCGGGGAGA |

TABLE 38-continued

| SEQ ID NO: | Description | Sequence |
|---|---|---|
| | | AGTGACTTTTCTCTCGCTTACTTGGAGGGAACCTTGCTAT
TTGGACACATGCTGCAGACGTTTCTTGAAAATGGAGAAA
ATGTCACGGGTCCCAAGTTTGCTCGTGCATTCAGGAATC
TCACTTTTCAAGGCTTTGCAGGACCTGTGACTCTGGATG
ACAGTGGGGACATTGACAACATTATGTCCCTTCTGTATGT
GTCTCTGGATACCAGGAAATACAAGGTTCTTATGAAGTAT
GACACCCACAAAAACAAAACTATTCCGGTGGCTGAGAAC
CCCAACTTCATCTGGAAGAACCACAAGCTCCCCAATGAC
GTTCCTGGGCTGGGCCCTCAAATCCTGATGATTGCCGTC
TTCACGCTCACGGGGATCCTGGTAGTTCTGCTGCTGATT
GCCCTCCTCGTGCTGAGAAAATACAGAAGAGATCATGCA
CTTCGACAGAAGAAATGGTCCCACATTCCTTCTGAAAAC
ATCTTTCCTCTGGAGACCAACGAGACCAACCACATCAGC
CTGAAGATTGACGATGACAGGAGACGAGACACAATCCAG
AGAGTGCGACAGTGCAAATACGACAAGAAGAAAGTGATT
CTGAAAGACCTCAAGCACAGCGACGGGAACTTCAGTGA
GAAGCAGAAGATAGACCTGAACAAGTTGCTGCAGTCTGA
CTACTACAACCTGACTAAGTTCTACGGCACCGTGAAGCT
GGACACCAGGATCTTTGGGGTGGTTGAGTACTGCGAGA
GGGGATCCCTCCGGGAAGTGTTAAACGACACAATTTCCT
ACCCTGACGGCACGTTCATGGATTGGGAGTTTAAGATCT
CTGTCTTAAATGACATCGCTAAGGGGATGTCCTACCTGC
ACTCCAGTAAGATTGAAGTCCACGGGCGTCTCAAATCCA
CCAACTGCGTGGTGGACAGCCGCATGGTGGTGAAGATC
ACCGACTTTGGGTGCAATTCCATCCTGCCTCCAAAAAAA
GACCTGTGGACGGCCCCGGAGCCTGCGCCAGGCCA
CCATCTCTCAGAAAGGAGACGTGTACAGCTTCGCCATCA
TTGCCCAGGAGATCATCCTCCGTAAGGAGACTTTTTACA
CGCTGAGCTGTCGGGATCACAATGAGAAGATTTTCAGAG
TGGAAAATTCATACGGGAAACCTTTCCGCCCAGACCTCT
TCCTGGAGACTGCAGATGAGAAGGAGCTGGAGGTCTAT
CTACTTGTCAAAAGCTGTTGGGAGGAGGATCCAGAAAAG
AGGCCAGATTTCAAGAAAATCGAGAGCACACTGGCCAAG
ATATTTGGCCTTTTCCATGACCAGAAAAACGAGTCTTACA
TGGACACCTTGATCCGACGTCTCCAGCTGTACTCTCGAA
ACCTGGAACATCTGGTGGAGGAAAGGACTCAGCTGTACA
AGGCGGAGAGGGACAGGGCTGACCACCTTAACTTCATG
CTCCTCCCACGGCTGGTGGTAAAGTCACTGAAGGAGAAA
GGCATCGTGGAGCCAGAGCTGTACGAAGAAGTCACAAT
CTACTTCAGTGACATTGTGGGCTTCACCACCATCTGCAA
GTATAGCACGCCCATGGAGGTGGTGGACATGCTCAACG
ACATCTACAAGAGCTTTGACCAGATTGTGGACCACCATG
ACGTCTACAAGGTAGAAACCATCGGTGACGCCTACGTGG
TGGCCAGCGGTCTGCCTATGAGAAACGGCAACCGACAC
GCGGTAGACATTTCCAAGATGGCCTTGGACATCCTCAGC
TTCATAGGGACCTTTGAGTTGGAGCATCTCCCTGGCCTC
CCCGTGTGGATCCGCATTGGAGTTCATTCTGGGCCCTGC
GCTGCTGGTGTTGTGGGGATCAAGATGCCTCGCTATTGC
CTGTTTGGAGACACTGTCAACACTGCCTCCAGGATGGAA
TCCACCGGCCTCCCCTTGAGGATTCACATGAGCAGCTCC
ACCATAACCATCCTGAAGAGAACGGATTGCCAGTTCCTG
TATGAAGTGAGGGGAGAAACCTACTTAAAGGGAAGAGG
GACAGAGACCACATACTGGCTGACTGGGATGAAGGACC
AAGAATACAACCTGCCATCCCCACCGACAGTGGAGAACC
AACAGCGTCTGCAGACTGAGTTCTCAGACATGATCGTTA
GCGCCTTACAGAAAAGACAGGCCTCGGGCAAGAAGAGC
CGGAGGCCCACTCGGGTGGCCAGCTACAAGAAAGGCTT
TCTGGAATACATGCAGCTGAACAATTCAGACCACGATAG
CACCTATTTTACGCGTACGCGGCCGCTCGAGCAGAAACT
CATCTCAGAAGAGGATCTGGCAGCAAATGATATCCTGGA
TTACAAGGATGACGACGATAAG |
| 230 | Human GUCY2C ECD-muIgG2a | SQVSQNCHNGSYEISVLMMGNSAFAEPLKNLEDAVNEGLEI
VRGRLQNAGLNVTVNATFMYSDGLIHNSDCRSSTCEGLD
LLRKISNAQRMGCVLIGPSCTYSTFQMYLDTELSYPMISAG
SFGLSCDYKETLTRLMSPARKLMYFLVNFWKTNDLPFKTYS
WSTSYVYKNGTETEDCFWYLNALEASVSYFSHELGFKWL
RQDKEFQDILMDHNRKSNVIIMCGGPEFLYKLKGDRAVAED
IVIILVDLFNDQYFEDNVTAPDYMKNVLVLTLSPGNSLLNSSF
SRNLSPTKRDFALAYLNGILLFGHMLKIFLENGENITTPKFAH
AFRNLTFEGYDGPVTLDDWGDVDSTMVLLYTSVDTKKYKV
LLTYDTHVNKTYPVDMSPTFTWKNSKLPNDITGRGPQGG
GSENLYFQGGGGSGGGGSEPRGPTIKPCPPCKCPAPNLE
GGPSVFIFPPKIKDVLMISLSPIVTCVVVDVSEDDPDVQISWF
VNNVEVHTAQTQTHREDYNSTLRWSALPIQHQDWMSGKA
FACAVNNKDLPAPIERTISKPKGSVRAPQVYVLPPPEEEMT
KKQVTLTCMVTDFMPEDIYVEWTNNGKTELNYKNTEPVLD |

TABLE 38-continued

| SEQ ID NO: | Description | Sequence |
|---|---|---|
| | | SDGSYFMYSKLRVEKKNWVERNSYSCSWHEGLHNHHTT<br>KSFSRTPGGGPPDYKDDDDK |
| 231 | Human GUCY2C ECD-muIgG2a | ATGGAGACAGACACACTGCTCCTGTGGGTGCTGCTTCTG<br>TGGGTGCCAGGTTCCACTGGAtcacaggtgagtcagaactgccaca<br>atggcagctatgaaatcagcgtcctgatgatgggcaactcagccttttgcagagccc<br>ctgaaaaacttggaagatgcggtgaatgaggggctggaaatagtgagaggacgt<br>ctgcaaaatgctggcctaaatgtgactgtgaacgctactttcatgtattcggatggtctg<br>attcataactcaggcgactgccggagtagcacctgtgaaggcctcgacctactcag<br>gaaaatttcaaatgcacaacggatgggctgtgtcctcatagggccctcatgtacata<br>ctccaccttccagatgtaccttgacacagaattgagctaccccatgatctcagctgga<br>agttttggattgtcatgtgactataaagaaaccttaaccaggctgatgtctccagctag<br>aaagttgatgtacttcttggttaactttggaaaaccaacgatctgcccttcaaaacttat<br>tcctggagcacttcgtatgtttacaagaatggtacagaaactgaggactgtttctggta<br>ccttaatgctctgtgaggctagcgtttcctatttctcccacgaactcggctttaaggtggt<br>gttaagacaagataaggagtttcaggatatcttaatggaccacaacaggaaaagc<br>aatgtgattatatgtgtggtggtccagagttcctctacaagctgaagggtgaccgag<br>cagtggctgaagacattgtcattattctagtggatcttttcaatgaccagtactttgagg<br>acaatgtcacagcccctgactatatgaaaaatgtccttgttctgacgctgtctcctggg<br>aattcccttctaaatagctctttctccaggaatctatcaccaacaaaacgagactttgct<br>cttgcctatttgaatggaatcctgctctttggacatatgctgaagatatttcttgaaatg<br>gagaaaatattaccaccccaaatttgctcatgctttcaggaatctcacttttgaaggg<br>tatgacggtccagtgaccttggatgactgggggatgttgacagtaccatggtgcttc<br>tgtatacctctgtggacaccaagaaatacaaggttcttttgacctatgatacccacgta<br>aataagacctatcctgtggatatgagccccacattcacttggaagaactctaaacttc<br>ctaatgatattacaggccgggcccctcagggaggcggaggttccGAGAATTT<br>ATACTTCCAGGGCGGAGGCGGTTCCGGCGGCGGAGGA<br>AGCgagccccgcggaccgacaatcaagccctgtcctccatgcaaatgcccagc<br>acctaacctcgagggtggaccatccgtcttcatcttccctccaaagatcaaggatgta<br>ctcatgatctccctgagccccatagtcacatgtgtggtggtggatgtgagcgaggatg<br>acccagatgtccagatcagctggtttgtgaacaacgtggaagtacacacagctcag<br>acacaaacccatagagaggattacaacagtactctccgggtggtcagtgccctcc<br>catccagcaccaggactggatgagtggcaaggctttcgcatgcgccgtcaacaac<br>aaagacctcccagcgcccatcgagagaaccatctcaaaacccaaagggtcagta<br>agagctccacaggtatatgtcttgcctccaccagaagaagagatgactaagaaac<br>aggtcactctgacctgcatggtcacagacttcatgcctgaagacatttacgtggagtg<br>gaccaacaacgggaaaacagagctaaactacaagaacactgaaccagtcctgg<br>actctgatggttcttacttcatgtacagcaagctgagagtggaaaagaagaactggg<br>tggaaagaaatagctactcctgttcagtggtccacgagggtctgcacaatcaccac<br>acgactaagagcttctcccggactccgggtGGCGGGCCACCCGACTA<br>CAAGGACGACGATGACAAA |
| 232 | Human GUCY2C ECD Cleaved | SQVSQNCHNGSYEISVLMMGNSAFAEPLKNLEDAVNEGLEI<br>VRGRLQNAGLNVTVNATFMYSDGLIHNSGDCRSSTCEGLD<br>LLRKISNAQRMGCVLIGPSCTYSTFQMYLDTELSYPMISAG<br>SFGLSCDYKETLTRLMSPARKLMYFLVNFWKTNDLPFKTYS<br>WSTSYVYKNGTETEDCFWYLNALEASVSYFSHELGFKWL<br>RQDKEFQDILMDHNRKSNVIIMCGGPEFLYLKGDRAVAED<br>IVIILVDLFNDQYFEDNVTAPDYMKNVLVLTLSPGNSLLNSSF<br>SRNLSPTKRDFALAYLNGILLFGHMLKIFLENGENITTPKFAH<br>AFRNLTFEGYDGPVTLDDWGDVDSTMVLLYTSVDTKKYKV<br>LLTYDTHVNKTYPVDMSPTFTWKNSKLPNDITGRGPQGGG<br>GSENLYFQ |
| 233 | Human GUCY2C ECD Cleaved | tcacaggtgagtcagaactgccacaatggcagctatgaaatcagcgtcctgatgat<br>gggcaactcagccttttgcagagcccctgaaaaacttggaagatgcggtgaatgag<br>gggctgaaatagtgagaggacgtctgcaaaatgctggcctaaatgtgactgtgaa<br>cgctactttcatgtattcggatggtctgattcataactcaggcgactgccggagtagca<br>cctgtgaaggcctcgacctactcaggaaaatttcaaatgcacaacggatgggctgt<br>gtcctcatagggccctcatgtacatactccaccttccagatgtaccttgacacagaatt<br>gagctaccccatgatctcagctggaagttttggattgtcatgtgactataaagaaacct<br>taaccaggctgatgtctccagctagaaagttgatgtacttcttggttaactttggaaaa<br>ccaacgatctgcccttcaaaacttattcctggagcacttcgtatgtttacaagaatggt<br>acagaaactgaggactgtttctggtaccttaatgctctgtgaggctagcgtttcctattct<br>cccacgaactcggctttaaggtggtgttaagacaagataaggagtttcaggatatctt<br>aatggaccacaacaggaaaagcaatgtgattatatgtgtggtggtccagagttcct<br>ctacaagctgaagggtgaccgagcagtggctgaagacattgtcattattctagtgga<br>tcttttcaatgaccagtactttgaggacaatgtcacagcccctgactatatgaaaaatg<br>tccttgttctgacgctgtctcctgggaattcccttctaaatagctctttctccaggaatctat<br>caccaacaaaacgagactttgctcttgcctatttgaatggaatcctgctctttggacat<br>atgctgaagatatttcttgaaatggagaaaatattaccaccccaaatttgctcatgc<br>tttcaggaatctcacttttgaagggtatgacggtccagtgaccttggatgactggggg<br>gatgttgacagtaccatggtgcttctgtatacctctgtggacaccaagaaatacaagg<br>ttcttttgacctatgatacccacgtaaataagacctatcctgtggatatgagccccaca<br>ttcacttggaagaactctaaacttcctaatgatattacaggccgggcccctcaggga<br>ggcggaggttccGAGAATTTATACTTCCAG |

TABLE 38-continued

| SEQ ID NO: | Description | Sequence |
|---|---|---|
| 234 | Cynomolgus GUCY2C ECD-muIG2a | SQVSQNCHNGSYEISVLMMDNSAFAEPLENVEDAVNEGLE IVRGRLQNAGLNVTVNASFMYSDGLIHNSGDCRSSTCEGL DLLRKISNAKRMGCVLMGPSCTYSTFQMYLDTELSYPMISA GSFGLSCDYKETLTRLMSPARKLTYFLVNFWKTNDLPFKTY SWSTSYVYKNGTESEDCFWYLNALEASVSYFSHELSFKLV LRQDKEFQDILMDHNRKSNVIVMCGDPEFLYKLKGDRAVA EDIVIILVDLFNDQYFEDNVTAPDYMKNVLVLTQSPGNSLLN SSFSRNLSPTKRDFALAYLNGILLFGHMLKTFLENGENITTP KFAHAFRNLTFEGYDGPVTLDDWGDVDSTMVLLYTSVDTK KYKVLLTYDTHVNQTNPVDMSPTFTWKNSKLPNDITDRGP QGGGGSENLYFQGGGGSGGGGSEPRGPTIKPCPPCKCPA PNLEGGPSVFIFPPKIKDVLMISLSPIVTCVVVDVSEDDPDV QISWFVNNVEVHTAQTQTHREDYNSTLRWSALPIQHQDW MSGKAFACAVNNKDLPAPIERTISKPKGSVRAPQVYVLPPP EEEMTKKQVTLTCMVTDFMPEDIYVEWTNNGKTELNYKNT EPVLDSDGSYFMYSKLRVEKKNWVERNSYSCSWHEGLH NHHTTKSFSRTPGGGPPDYKDDDDK |
| 235 | Cynomolgus GUCY2C ECD-muIG2a | tcacaggtgagtcagaactgccacaatggcagctatgaaatcagcgtcctgatgat ggacaactcagcctttgcagagcccctggaaaacgtggaagatgcggtgaatgag gggctggaaatagtgagaggacgtctgcaaaacgctggcctaaatgtgactgtga atgcttctttcatgtattcggatggtctgattcataactccggcgactgccggagcagc acctgtgaaggccttgacctactcaggaaaatttcaaatgcaaaacggatgggctgt gtcctcatgggccctcatgtacatactccaccttccagatgtaccttgacacagaatt gagctacccatgatctcagctggaagttttggattgtcatgtgactataaagaaacct taaccaggctgatgtctccagctagaaagttgacatacttcttggttaacttttggaaa accaatgatctacccttcaaaacttattcctggagcacttcgtatgtttacaagaatggt acggagtccgaggactgtttctggtaccttaacgctctggaggcagtgtttcctatttc tcccacgaactcagttttaagttggtgttaagacaagataaggagtttcaggatatctt aatggaccacaacaggaaaagcaatgtgattgttatgtgtggtgatccaGagttcct ctacaagttgaagggtgaccgagcagtggctgaagacattgtcattattctagtggat cttttcaatgaccagtactttgaggacaatgtcacagcccctgactatatgaaaaatgt ccttgttctgacgcagtctcctgggaattcctcctaaatagctctttctccaggaatcta tccccaacaaaacgagactttgctcttgcctatttgaatggaatcctgctctttggacat atgctaaagacatttcttgaaaatggagaaatattaccaccccccaaatttgctcatg ctttcaggaatctcacttttgaagggtatgacggtccagtgaccttggatgactgggg ggatgtggacagtaccatggtgcttctgtatacgtctgtggacaccaagaaatacaa ggttctttttgacctatgatacccacgtaaatcagaccaacccctgtggatatgagcccc acattcacttggaagaatctcaaacttcctaatgatattacagaccggggccctcag ggaggcggaggttccGAGAATTTATACTTCCAGGGCGGAGGCG GTTCCGGCGGCGGAGGAAGCgagccccgcggaccgacaatcaag ccctgtcctccatgcaaatgcccagcacctaacctcgagggtggaccatccgtcttc atcttccctccaaagatcaaggatgtactcatgatctccctgagcccccatagtcacat gtgtggtggtggatgtgagcgaggatgacccagatgtccagatcagctggttttgtga acaacgtggaagtacacacagctcagacacaaacccatagagaggattacaac agtactctccgggtggtcagtgccctcccatccagcaccaggactggatgagtgg caaggctttcgcatgcgccgtcaacaacaaagacctcccagcgcccatcgagag aaccatctcaaaacccaaagggtcagtaagagctccacaggtatatgtcttgcctcc accagaagaagagatgactaagaaacaggtcactctgacctgcatggtcacaga cttcatgcctgaagacatttacgtggagtggaccaacaacgggaaaacagagcta aactacaagaacactgaaccagtcctggactctgatggttcttacttcatgtacagca agctgagagtggaaaagaagaactgggtggaaagaaatagctactcctgttcagt ggtccacgagggtctgcacaatcaccacacgactaagagcttctcccggactccg ggtGGCGGGCCACCCGACTACAAGGACGACGATGACAAA |
| 236 | Cynomolgus GUCY2C-ECD Cleaved | SQVSQNCHNGSYEISVLMMDNSAFAEPLENVEDAVNEGLE IVRGRLQNAGLNVTVNASFMYSDGLIHNSGDCRSSTCEGL DLLRKISNAKRMGCVLMGPSCTYSTFQMYLDTELSYPMISA GSFGLSCDYKETLTRLMSPARKLTYFLVNFWKTNDLPFKTY SWSTSYVYKNGTESEDCFWYLNALEASVSYFSHELSFKLV LRQDKEFQDILMDHNRKSNVIVMCGDPEFLYKLKGDRAVA EDIVIILVDLFNDQYFEDNVTAPDYMKNVLVLTQSPGNSLLN SSFSRNLSPTKRDFALAYLNGILLFGHMLKTFLENGENITTP KFAHAFRNLTFEGYDGPVTLDDWGDVDSTMVLLYTSVDTK KYKVLLTYDTHVNQTNPVDMSPTFTWKNSKLPNDITDRGP QGGGGSENLYFQ |
| 237 | Cynomolgus GUCY2C-ECD Cleaved | tcacaggtgagtcagaactgccacaatggcagctatgaaatcagcgtcctgatgat ggacaactcagcctttgcagagcccctggaaaacgtggaagatgcggtgaatgag gggctggaaatagtgagaggacgtctgcaaaacgctggcctaaatgtgactgtga atgcttctttcatgtattcggatggtctgattcataactccggcgactgccggagcagc acctgtgaaggccttgacctactcaggaaaatttcaaatgcaaaacggatgggctgt gtcctcatgggccctcatgtacatactccaccttccagatgtaccttgacacagaatt gagctacccatgatctcagctggaagttttggattgtcatgtgactataaagaaacct taaccaggctgatgtctccagctagaaagttgacatacttcttggttaacttttggaaa accaatgatctacccttcaaaacttattcctggagcacttcgtatgtttacaagaatggt acggagtccgaggactgtttctggtaccttaacgctctggaggcagtgtttcctatttc |

TABLE 38-continued

| SEQ ID NO: | Description | Sequence |
|---|---|---|
| | | tcccacgaactcagttttaagttggtgttaagacaagataaggagtttcaggatatctt<br>aatggaccacaacaggaaaagcaatgtgattgttatgtgtggtgatccaGagttcct<br>ctacaagttgaaggtgaccgagcagtggctgaagacattgtcattattctagtggat<br>cttttcaatgaccagtactttgaggacaatgtcacagcccctgactatatgaaaaatgt<br>ccttgttctgacgcagtctcctgggaattccctcctaaatagctcttctccaggaatcta<br>tccccaacaaaacgagactttgctcttgcctatttgaatggaatcctgctctttggacat<br>atgctaaagacattcttgaaaatggagaaaatattaccacccccaaatttgctcatg<br>ctttcaggaatctcacttttgaagggtatgacggtccagtgaccttggatgactgggg<br>ggatgtggacagtaccatggtgcttctgtatacgtctgtggacaccaagaaatacaa<br>ggttcttttgacctatgatacccacgtaaatcagaccaaccctgtggatatgagcccc<br>acattcacttggaagaactctaaacttcctaatgatattacagaccggggccctcag<br>ggaggcggaggttccGAGAATTTATACTTCCAG |
| 238 | Murine GUCY2C ECD-muIgG2a | VFWASQVRQNCRNGSYEISVLMMDNSAYKEPMQNLREAV<br>EEGLDIVRKRLREADLNVTVNATFIYSDGLIHKSGDCRSSTC<br>EGLDLLREITRDHKMGCALMGPSCTYSTFQMYLDTELNYP<br>MISAGSYGLSCDYKETLTRILPPARKLMYFLVDFWKVNNAS<br>FKPFSWNSSYVYKNGSEPEDCFWYLNALEAGVSYFSEVLN<br>FKDVLRRSEQFQEILTGHNRKSNVIVMCGTPESFYDVKGDL<br>QVAEDTWILVDLFSNHYFEENTTAPEYMDNVLVLTLPSEQ<br>STSNTSVAERFSSGRSDFSLAYLEGTLLFGHMLQTFLENGE<br>NVTGPKFARAFRNLTFQGFAGPVTLDDSGDIDNIMSLLYVS<br>LDTRKYKVLMKYDTHKNKTIPVAENPNFIWKNHKLPNDVPG<br>LGPQILMGGGGSENLYFQGGGGSGGGGSEPRGPTIKPCP<br>PCKCPAPNLEGGPSVFIFPPKIKDVLMISLSPIVTCVVVDVSE<br>DDPDVQISWFVNNVEVHTAQTQTHREDYNSTLRWSALPIQ<br>HQDWMSGKAFACAVNNKDLPAPIERTISKPKGSVRAPQVY<br>VLPPPEEEMTKKQVTLTCMVTDFMPEDIYVEWTNNGKTEL<br>NYKNTEPVLDSDGSYFMYSKLRVEKKNWVERNSYSCSW<br>HEGLHNHHTTKSFSRTPGHHHHHH |
| 239 | Murine GUCY2C ECD-muIgG2a | gtgttctgggcctctcaggtgaggcagaactgccgcaatggcagctacgagatcag<br>cgtcctgatgatggacaactcagcctacaaagaacctatgcaaaacctgagggag<br>gctgtggaggaaggactggacatagtgcgaaagcgcctgcgtgaagccgaccta<br>aatgtgactgtgaacgcgactttcatctactccgacggtctgattcataagtcaggtga<br>ctgccggagcagcacctgtgaaggccttgacctactcagggagattacaagagat<br>cataagatgggctgcgccctcatgggccctgtgcacgtattccaccttccagatgt<br>acctcgacacagagttgaactatcccatgatttccgctgaagttatggattgtcctgt<br>gactataaggaaacccttaaccaggattctgcctccagccaggaagctgatgtactt<br>cttggtcgatttctggaaagtcaacaatgcatcttttcaaaccctttttcctggaactcttcg<br>tatgtttacaagaatggatcggaacctgaagattgtttctggtacctcaatgctctgga<br>ggctggggtgtcctattttctgaggtgctcaacttcaaggatgtactgagacgcagcg<br>aacagttccaggaaatcttaacaggccataacagaaagagcaatgtgattgttatgt<br>gtggcacgccagaaagcttctatgatgtgaaaggtgacctccaagtggctgaagat<br>actgttgtcatcctggtagatctgttcagtaaccattactttgaggagaacaccacagc<br>tcctgagtatatggacaatgtcctcgtcctgacgctgccgtctgaacagtccacctca<br>aacacctctgtcgccgagaggttttcatcggggagaagtgacttttctctcgcttacttg<br>gagggaaccttgctatttggacacatgctgcagacgtttcttgaaaatggagaaaat<br>gtcacgggtcccaagtttgctcgtgcattcaggaatctcacttttcaaggctttgcagg<br>acctgtgactctggatgacagtggggacattgacaacattatgtcccttctgtatgtgtc<br>tctggataccaggaaatacaaggttcttatgaagtatgacacccacaaaaacaaa<br>actattccggtggctgagaaccccaacttcatctggaagaaccacaagctccccaa<br>tgacgttcctgggctgggccctcaaatcctgatgggaggcggaggttccGAGAA<br>TTTATACTTCCAGGGCGGAGGCGGTTCCGGCGGCGGAG<br>GAAGCgagcccgcggaccgacaatcaagccctgtcctccatgcaaatgccc<br>agcacctaacctcgagggtggaccatccgtcttcatcttccctccaaagatcaagga<br>tgtactcatgatctccctgagcccatagtcacatgtgtggtggtggatgtgagcgag<br>gatgacccagatgtccagatcagctggtttgtgaacaacgtggaagtacacacagc<br>tcagacacaaacccatagagaggattacaacagtactctccgggtggtcagtgcc<br>ctcccatccagcaccaggactggatgagtggcaaggcttcgcatgcgccgtcaa<br>caacaaagacctcccagcgcccatcgagagaaccatctcaaaacccaaagggt<br>cagtaagagctccacaggtatatgtcttgcctccaccagaagaagagatgactaag<br>aaacaggtcactctgacctgcatggtcacagacttcatgcctgaagacatttacgtg<br>gagtggaccaacaacgggaaaacagagctaaactacaagaacactgaaccagt<br>cctggactctgatggttcttacttcatgtacagcaagctgagagtggaaaagaagaa<br>ctgggtggaaagaaatagctactcctgttcagtggtccacgagggtctgcacaatca<br>ccacacgactaagagcttccccggactccgggtCACCATCACCATCAC<br>CAT |
| 240 | Murine GUCY2C-ECD cleaved | VFWASQVRQNCRNGSYEISVLMMDNSAYKEPMQNLREAV<br>EEGLDIVRKRLREADLNVTVNATFIYSDGLIHKSGDCRSSTC<br>EGLDLLREITRDHKMGCALMGPSCTYSTFQMYLDTELNYP<br>MISAGSYGLSCDYKETLTRILPPARKLMYFLVDFWKVNNAS<br>FKPFSWNSSYVYKNGSEPEDCFWYLNALEAGVSYFSEVLN<br>FKDVLRRSEQFQEILTGHNRKSNVIVMCGTPESFYDVKGDL<br>QVAEDTWILVDLFSNHYFEENTTAPEYMDNVLVLTLPSEQ<br>STSNTSVAERFSSGRSDFSLAYLEGTLLFGHMLQTFLENGE |

TABLE 38-continued

| SEQ ID NO: | Description | Sequence |
|---|---|---|
| | | NVTGPKFARAFRNLTFQGFAGPVTLDDSGDIDNIMSLLYVS LDTRKYKVLMKYDTHKNKTIPVAENPNFIWKNHKLPNDVPG LGPQILMGGGGSENLYFQ |
| 241 | Murine GUCY2C-ECD cleaved | gtgttctgggcctctcaggtgaggcagaactgccgcaatggcagctacgagatcag cgtcctgatgatggacaactcagcctacaaagaacctatgcaaaacctgagggag gctgtggaggaaggactggacatagtgcgaaagcgcctgcgtgaagccgaccta aatgtgactgtgaacgcgactttcatctactccgacggtctgattcataagtcaggtga ctgccggagcagcacctgtgaaggccttgacctactcagggagattacaagagat cataagatgggctgcgccctcatgggccctcgtgcacgtattccaccttccagatgt accctcgacacagagttgaactatcccatgatttccgctggaagttatggattgtcctgt gactataaggaaaccctaaccaggattctgcctccagccaggaagctgatgtactt cttggtcgatttctggaaagtcaacaatgcatcttcaaaccctttcctggaactcttcg tatgtttacaagaatggatcggaacctgaagattgttctggtacctcaatgctctgga ggctggggtgtcctattttctgaggtgctcaacttcaaggatgtactgagacgcagcg aacagttccaggaaatcttaacaggccataacagaaagagcaatgtgattgttatgt gtggcacgccagaaagcttctatgatgtgaaaggtgacctccaagtggctgaagat actgttgtcatcctggtagatctgttcagtaaccattactttgaggagaacaccacagc tcctgagtatatggacaatgtcctcgtcctgacgctgccgtctgaacagtccacctca aacacctctgtcgccgagaggttttcatcggggagaagtgacttttctctcgcttacttg gagggaaccttgctatttggacacatgctgcagacgtttcttgaaaatggagaaaat gtcacgggtcccaagtttgctcgtgcattcaggaatctcactttcaaggctttgcagg acctgtgactctggatgacagtggggacattgacaacattatgtcccttctgtatgtgtc tctggataccaggaaatacaaggttcttatgaagtatgacacccacaaaaacaaa actattccggtggctgagaaccccaacttcatctggaagaaccacaagctccccaa tgacgttcctgggctgggccctcaaatcctgatgggaggcggaggttccGAGAA TTTATACTTCCAG |
| 242 | Human CD3 epsilon-delta | MQSGTHWRVLGLCLLSVGVWGQDGNEEMGGITQTPYKVS ISGTTVILTCPQYPGSEILWQHNDKNIGGDEDDKNIGSDEDH LSLKEFSELEQSGYYVCYPRGSKPEDANFYLYLRARGGGG SGGGGSGGGGSPIEELEDRVFVNCNTSITWVEGTVGTLLS DITRLDLGKRILDPRGIYRCNGTDIYKDKESTVQVHYRMCQ SCVELDHHHHHH |
| 243 | Human CD3 epsilon-delta | atgcaatccggtacgcactggagagtcttgggtctgtgccttttgtctgttggcgtatgg gggcaagacgggaacgaagaaatgggaggcattacacaaacaccatacaagg tatcaattagcggcacgacggttatactgacatgtccacaatatccaggcagcgaa attctgtggcagcacaatgacaagaatattggggagatgaagacgacaaaaata tcggtagcgacgaggaccatctgtctctgaaggaattttcagaacttgaacaatctgg ctattatgtgtgctacccgcgaggcagcaaaccggaagatgcaaacttttacctttat ctgagagcaaggggcggcggaggctctggggcggaggcagcggcggagga ggatcaccaatcgaggaattggaagatagggtattcgtaaattgtaacaccagcatt acatgggtggaagggaccgttggaactctcctgagcgatatcacacgactggatctt ggtaaacgaatcctggaccacgcggaatctatagatgtaacggaactgatatttac aaagacaaagaatctactgtgcaagttcactaccgaatgtgtcaatcatgcgttgaa ctcgatcaccaccaccatcatcac |
| 244 | Cynomolgus CD3 epsilon-delta | MQSGTHWRVLGLCLLSVGVWGQDGNEEMGSITQTPYQVS ISGTTVILTCSQHLGSEAQWQHNGKNKGDSGDQLFLPEFS EMEQSGYYVCYPRGSNPEDASHHLYLKARGGGGSGGGG SGGGGSPVEELEDRVFVKCNTSVTWVEGTVGTLLTNNTRL DLGKRILDPRGIYRCNGTDIYKDKESAVQVHYRMCQNCVEL DHHHHHH |
| 245 | Cynomolgus CD3 epsilon-delta | atgcaaagcggaactcattggcgcgtcctgggactctgtctgctctccgtgggagtct ggggacaagatggaaacgaagagatgggaagcattacacaaacaccatacca agtctccattagcggcactaccgtcattctgacatgttcccaacatctgggcagcgaa gctcaatggcagcacaatgaaagaataagggcgatagcggagaccaactgttt ctgccagaatttagcgaaatggagcaatccggctattacgtgtgctacccacgcgg cagcaaccctgaagatgctagccatcacctctatctgaaggctcgcggaggcgga ggcagcggcggcggaggatccggcggaggcggaagccagtcgaggaactgg aagatcgcgtcttcgtgaagtgtaacaccagcgtcacatgggtggaaggcaccgtc ggaactctcctgactaacaacacacgcctggatctcggaaaacgcatcctggacc cacgcggaatctatagatgtaacggaactgatatttacaaagacaaagaatccgct gtgcaagtccactaccgcatgtgtcaaaactgtgtcgaactggatcatcaccatcac catcac |
| 246 | GUCY2C-1608_Knob | gacatccagctgacccagtctccatcctccctgtctgcatctgtaggagacagagtc accatcacttgcagagccagtgaaagtgttgattattatggcagtagtttattgcagtg gtatcagcagaaaccagggaaagcccctaagctcctgatctatgctgcatccaaac tagcttctggggtcccatcaaggttcagtggcagtggatctgggacagatttcactctc accatcagcagtctgcaacctgaagattttgcaacttactactgtcagcaaactcgg aaagcgtatacgtttggccaggggaccaagctggagatcaaggtggaggtagc gggggcggcggggaagttcaactcgttgagtctggcggggattggttcaacccg gtggaagccttagattgtcatgtgccgcctccggctttacatttagcgactattacatga cctgggtgagacaagctccaggcaaaggacttgaatgggtggcctttatcagaaat |

TABLE 38-continued

| SEQ ID NO: | Description | Sequence |
|---|---|---|
| | | caggcccgcggctacacaagcgaccataatccctccgtgaaaggaagatttacca<br>tcagccgggacaatgctaaaaattcactttaccttcaaatgaactctcttagagccga<br>ggacaccgccgtatactactgcgcaagagatagaccaagttattacgtcctggatta<br>ctggggccagggaacaaccgtcaccgtgtcttctggatgcccaccgtgcccagca<br>cctgaagccgctggggaccgtcagtcttcctcttcccccaaaacccaaggacac<br>cctcatgatctcccggacccctgaggtcacatgcgtggtggtggacgtgagccacg<br>aagaccctgaggtcaagttcaactggtacgtggacggcgtggaggtgcataatgcc<br>aagacaaagccgcgggaggagcagtacaacagcacgtaccgtgtggtcagcgt<br>cctcaccgtcctgcaccaggactggctgaatggcaaggagtacaagtgcaaggtc<br>tccaacaaagccctcccagcccccatcgagaaaaccatctccaaagccaaaggg<br>cagccccgagaaccacaggtgtgcaccctgcccccatcccgggaggagatgacc<br>aagaaccaggtcagcctgtggtgcctggtcaaaggcttctatcccagcgacatcgc<br>cgtggagtgggagagcaatgggcagccggagaacaactacaagaccacgcctc<br>ccgtgctggactccgacggctccttcttcctctatagcaagctcaccgtggacaaga<br>gcaggtggcagcaggggaacgtcttctcatgctccgtgatgcatgaggctctgcac<br>aaccactacacgcagaagagcctctccctgtcccccggaaag |
| 247 | GUCY2C-1608_Hole | gacatccagatgacccagtcccccctcttctctgtctgcctctgtgggcgacagagtga<br>ccatcacctgcacaagctcacagtcactgtttaatgtccgcagcagaaaaactatc<br>ttgcgtggtatcagcagaagcctggcaaggctcccaagctgctgatctactgggcc<br>agtacacgagaatccggcgtgccttccagattctccggctctggctctggcaccgatt<br>tcaccctgaccatctcctccctccagcctgaggatttcgccacctactactgcaaaca<br>gtcttacgacctttttcacttttggcggcggaacaaaggtggagatcaagggcggag<br>gtggatctggcggcggaggcgaggtgcagctggtggagtctggggggaggcttggt<br>ccagcctggggggtccctgagactctcctgtgcagcctctggcttcaccttcagcagc<br>tactggatgcactgggtccgccaggctccagggaaggggctggagtggattggag<br>agattaaacctagcaacgaacttactaacgtccatgaaaagttcaaggaccgattc<br>accatctccgtggacaaggccaagaactcagcctatctgcaaatgaacagcctga<br>gagccgaggacacggctgtgtattactgtacaagaacgattacgacgacggagg<br>gatactggttcttcgatgtctggggccaagggacactggtcaccgtctcttcaggatgt<br>ccaccgtgcccagcacctgaagccgctggggaccgtcagtcttcctcttccccca<br>aaacccaaggacaccctcatgatctcccggacccctgaggtcacatgcgtggtggt<br>ggacgtgagccacgaagaccctgaggtcaagttcaactggtacgtggacggcgtg<br>gaggtgcataatgccaagacaaagccgcgggaggagcagtacaacagcacgta<br>ccgtgtggtcagcgtcctcaccgtcctgcaccaggactggctgaatggcaaggagt<br>acaagtgcaaggtctccaacaaagccctcccagcccccatcgagaaaaccatctc<br>caaagccaagggcagccccgagaaccacaggtgtacaccctgcccccatgcc<br>gggaggagatgaccaagaaccaggtcagcctgtcctgcgcggtcaaaggcttcta<br>tcccagcgacatcgccgtggagtgggagagcaatgggcagccggagaacaact<br>acaagaccacgcctcccgtgctggactccgacggctccttcttcctcgttagcaagct<br>caccgtggacaagagcaggtggcagcaggggaacgtcttctcatgctccgtgatg<br>catgaggctctgcacaaccactacacgcagaagagcctctccctgtcccccggaa<br>ag |
| 248 | GUCY2C-0250_Knob | DIQLTQSPSSLSASVGDRVTITCRASESVDYYGTSLMQWY<br>QQKPGKAPKLLIYAASNVESGVPSRFSGSGSGTDFTLTISS<br>LQPEDFATYYCQQTRKVYTFGQGTKLEIKGGGSGGGEV<br>QLVESGGGLVQPGGSLRLSCAASGFTFSDYYMTWVRQAP<br>GKGLEWVAFIRNRARGYTSDHNPSVKGRFTISRDNAKNSL<br>YLQMNSLRAEDTAVYYCARDRPSYYVLDYWGQGTTVTVS<br>SGCPPCPAPEAAGAPSVFLFPPKPKDTLMISRTPEVTCVVV<br>DVSHEDPEVKFNWYVDGVEVHNAKTKPREEQYNSTYRW<br>SVLTVLHQDWLNGKEYKCKVSNKALPAPIEKTISKAKGQPR<br>EPQVCTLPPSREEMTKNQVSLWCLVKGFYPSDIAVEWESN<br>GQPENNYKTTPPVLDSDGSFFLYSKLTVDKSRWQQGNVFS<br>CSVMHEALHNHYTQKSLSLSPG |
| 249 | GUCY2C-0250_Hole | DIQMTQSPSSLSASVGDRVTITCTSSQSLFNVRSRKNYLAW<br>YQQKPGKAPKLLIYWASTRESGVPSRFSGSGSGTDFTLTIS<br>SLQPEDFATYYCKQSYDLFTFGGGTKVEIKGGGSGGGGEV<br>QLVESGGGLVQPGGSLRLSCAASGYTFTSYWMHWVRQAP<br>GKGLEWIGEIKPSNGLTNYIEKFKNRFTISVDKAKNSAYLQM<br>NSLRAEDTAVYYCTRTITTTEGYWFFDVWGQGTLVTVSSG<br>CPPCPAPEAAGAPSVFLFPPKPKDTLMISRTPEVTCVVVDV<br>SHEDPEVKFNWYVDGVEVHNAKTKPREEQYNSTYRWSVL<br>TVLHQDWLNGKEYKCKVSNKALPAPIEKTISKAKGQPREPQ<br>VYTLPPCREEMTKNQVSLSCAVKGFYPSDIAVEWESNGQP<br>ENNYKTTPPVLDSDGSFFLVSKLTVDKSRWQQGNVFSCSV<br>MHEALHNHYTQKSLSLSPG |
| 250 | GUCY2C-250_monomer | DIQLTQSPSSLSASVGDRVTITCRASESVDYYGTSLMQWY<br>QQKPGKAPKLLIYAASNVESGVPSRFSGSGSGTDFTLTISS<br>LQPEDFATYYCQQTRKVYTFGQGTKLEIKGGGSGGGEV<br>QLVESGGGLVQPGGSLRLSCAASGFTFSDYYMTWVRQAP<br>GKGLEWVAFIRNRARGYTSDHNPSVKGRFTISRDNAKNSL<br>YLQMNSLRAEDTAVYYCARDRPSYYVLDYWGQGTTVTVS<br>SGCPPCPAPEAAGAPSVFLFPPKPKDTLMISRTPEVTCVVV |

TABLE 38-continued

| SEQ ID NO: | Description | Sequence |
|---|---|---|
| | | DVSHEDPEVKFNWYVDGVEVHNAKTKPREEQYNSTYRVV SVLTVLHQDWLNGKEYKCKVSNKALPAPIEKTISKAKGQPR EPQVCTLPPSREEMTKNQVSLWCLVKGFYPSDIAVEWESN GQPENNYKTTPPVLDSDGSFFLYSKLTVDKSRWQQGNVFS CSVMHEALHNHYTQKSLSLSPGDIQMTQSPSSLSASVGDR VTITCTSSQSLFNVRSRKNYLAWYQQKPGKAPKLLIYWAST RESGVPSRFSGSGSGTDFTLTISSLQPEDFATYYCKQSYDL FTFGGGTKVEIKGGGSGGGGEVQLVESGGGLVQPGGSLR LSCAASGYTFTSYWMHWVRQAPGKGLEWIGEIKPSNGLTN YIEKFKNRFTISVDKAKNSAYLQMNSLRAEDTAVYYCTRTIT TTEGYWFFDVWGQGTLVTVSSGCPPCPAPEAAGAPSVFLF PPKPKDTLMISRTPEVTCVVVDVSHEDPEVKFNWYVDGVE VHNAKTKPREEQYNSTYRWSVLTVLHQDWLNGKEYKCKV SNKALPAPIEKTISKAKGQPREPQVYTLPPCREEMTKNQVS LSCAVKGFYPSDIAVEWESNGQPENNYKTTPPVLDSDGSF FLVSKLTVDKSRWQQGNVFSCSVMHEALHNHYTQKSLSLS PG |
| 251 | Human GUCY2C Full Length GenBank accession No. NP_004954.2 | MKTLLLDLALWSLLFQPGWLSFSSQVSQNCHNGSYEISVL MMGNSAFAEPLKNLEDAVNEGLEIVRGRLQNAGLNVTVNA TFMYSDGLIHNSGDCRSSTCEGLDLLRKISNAQRMGCVLIG PSCTYSTFQMYLDTELSYPMISAGSFGLSCDYKETLTRLMS PARKLMYFLVNFWKTNDLPFKTYSWSTSYVYKNGTETEDC FWYLNALEASVSYFSHELGFKWLRQDKEFQDILMDHNRK SNVIIMCGGPEFLYKLKGDRAVAEDIVIILVDLFNDQYFEDNV TAPDYMKNVLVLTLSPGNSLLNSSFSRNLSPTKRDFALAYL NGILLFGHMLKIFLENGENITTPKFAHAFRNLTFEGYDGPVT LDDWGDVDSTMVLLYTSVDTKKYKVLLTYDTHVNKTYPVD MSPTFTWKNSKLPNDITGRGPQILMIAVFTLTGAWLLLLVA LLMLRKYRKDYELRQKKWSHIPPENIFPLETNETNHVSLKID DDKRRDTIQRLRQCKYDKKRVILKDLKHNDGNFTEKQKIEL NKLLQIDYYNLTKFYGTVKLDTMIFGVIEYCERGSLREVLND TISYPDGTFMDWEFKISVLYDIAKGMSYLHSSKTEVHGRLK STNCWDSRMWKITDFGCNSILPPKKDLWTAPEHLRQANI SQKGDVYSYGIIAQEIILRKETFYTLSCRDRNEKIFRVENSNG MKPFRPDLFLETAEEKELEVYLLVKNCWEEDPEKRPDFKKI ETTLAKIFGLFHDQKNESYMDTLIRRLQLYSRNLEHLVEERT QLYKAERDRADRLNFMLLPRLWKSLKEKGFVEPELYEEVT IYFSDIVGFTTICKYSTPMEWDMLNDIYKSFDHIVDHHDVYK VETIGDAYMVASGLPKRNGNRHAIDIAKMALEILSFMGTFEL EHLPGLPIWIRIGVHSGPCAAGWGIKMPRYCLFGDTVNTA SRMESTGLPLRIHVSGSTIAILKRTECQFLYEVRGETYLKGR GNETTYWLTGMKDQKFNLPTPPTVENQQRLQAEFSDMIAN SLQKRQAAGIRSQKPRRVASYKKGTLEYLQLNTTDKESTYF |
| 252 | Human GUCY2C Full Length GenBank Accession No. NM_004963.3 | GACCAGAGAGAAGCGTGGGGAAGAGTGGGCTGAGGGA CTCCACTAGAGGCTGTCCATCTGGATTCCCTGCCTCCCT AGGAGCCCAACAGAGCAAAGCAAGTGGGCACAAGGAGT ATGGTTCTAACGTGATTGGGGTCATGAAGACGTTGCTGT TGGACTTGGCTTTGTGGTCACTGCTCTTCCAGCCCGGGT GGCTGTCCTTTAGTTCCCAGGTGAGTCAGAACTGCCACA ATGGCAGCTATGAAATCAGCGTCCTGATGATGGGCAACT CAGCCTTTGCAGAGCCCCTGAAAAACTTGGAAGATGCGG TGAATGAGGGGCTGGAAATAGTGAGAGGACGTCTGCAA AATGCTGGCCTAAATGTGACTGTGAACGCTACTTTCATGT ATTCGGATGGTCTGATTCATAACTCAGGCGACTGCCGGA GTAGCACCTGTGAAGGCCTCGACCTACTCAGGAAAATTT CAAATGCACAACGGATGGGCTGTGTCCTCATAGGGCCCT CATGTACATACTCCACCTTCCAGATGTACCTTGACACAGA ATTGAGCTACCCCATGATCTCAGCTGGAAGTTTTGGATT GTCATGTGACTATAAAGAAACCTTAACCAGGCTGATGTCT CCAGCTAGAAAGTTGATGTACTTCTTGGTTAACTTTTGGA AAACCAACGATCTGCCCTTCAAAACTTATTCCTGGAGCA CTTCGTATGTTTACAAGAATGGTACAGAAACTGAGGACT GTTTCTGGTACCTTAATGCTCTGGAGGCTAGCGTTTCCT ATTTCTCCCACGAACTCGGCTTTAAGGTGGTGTTAAGAC AAGATAAGGAGTTTCAGGATATCTTAATGGACCACAACA GGAAAAGCAATGTGATTATTATGTGTGGTGGTCCAGAGT TCCTCTACAAGCTGAAGGGTGACCGAGCAGTGGCTGAA GACATTGTCATTATTCTAGTGGATCTTTTCAATGACCAGT ACTTTGAGGACAATGTCACAGCCCCTGACTATATGAAAA ATGTCCTTGTTCTGACGCTGTCTCCTGGGAATTCCCTTCT AAATAGCTCTTTCTCCAGGAATCTATCACCAACAAAACGA GACTTTGCTCTTGCCTATTTGAATGGAATCCTGCTCTTTG GACATATGCTGAAGATATTCTTGAAAATGGAGAAAATAT TACCACCCCCAAATTTGCTCATGCTTTCAGGAATCTCACT TTTGAAGGGTATGACGGTCCAGTGACCTTGGATGACTGG |

TABLE 38-continued

| SEQ ID NO: | Description | Sequence |
|---|---|---|
| | | GGGGATGTTGACAGTACCATGGTGCTTCTGTATACCTCT<br>GTGGACACCAAGAAATACAAGGTTCTTTTGACCTATGATA<br>CCCACGTAAATAAGACCTATCCTGTGGATATGAGCCCCA<br>CATTCACTTGGAAGAACTCTAAACTTCCTAATGATATTAC<br>AGGCCGGGGCCCTCAGATCCTGATGATTGCAGTCTTCAC<br>CCTCACTGGAGCTGTGGTGCTGCTCCTGCTCGTCGCTCT<br>CCTGATGCTCAGAAAATATAGAAAAGATTATGAACTTCGT<br>CAGAAAAAATGGTCCCACATTCCTCCTGAAAATATCTTTC<br>CTCTGGAGACCAATGAGACCAATCATGTTAGCCTCAAGA<br>TCGATGATGACAAAAGACGAGATACAATCCAGAGACTAC<br>GACAGTGCAAATACGACAAAAAGCGAGTGATTCTCAAAG<br>ATCTCAAGCACAATGATGGTAATTTCACTGAAAAACAGAA<br>GATAGAATTGAACAAGTTGCTTCAGATTGACTATTACAAC<br>CTGACCAAGTTCTACGGCACAGTGAAACTTGATACCATG<br>ATCTTCGGGGTGATAGAATACTGTGAGAGAGGATCCCTC<br>CGGGAAGTTTTAAATGACACAATTTCCTACCCTGATGGC<br>ACATTCATGGATTGGGAGTTTAAGATCTCTGTCTTGTATG<br>ACATTGCTAAGGGAATGTCATATCTGCACTCCAGTAAGA<br>CAGAAGTCCATGGTCGTCTGAAATCTACCAACTGCGTAG<br>TGGACAGTAGAATGGTGGTGAAGATCACTGATTTTGGCT<br>GCAATTCCATTTTACCTCCAAAAAAGGACCTGTGGACAG<br>CTCCAGAGCACCTCCGCCAAGCCAACATCTCTCAGAAAG<br>GAGATGTGTACAGCTATGGGATCATCGCACAGGAGATCA<br>TCCTGCGGAAAGAAACCTTCTACACTTTGAGCTGTCGGG<br>ACCGGAATGAGAAGATTTTCAGAGTGGAAAATTCCAATG<br>GAATGAAACCCTTCCGCCCAGATTTATTCTTGGAAACAG<br>CAGAGGAAAAAGAGCTAGAAGTGTACCTACTTGTAAAAA<br>ACTGTTGGGAGGAAGATCCAGAAAAGAGACCAGATTTCA<br>AAAAAATTGAGACTACACTTGCCAAGATATTTGGACTTTT<br>TCATGACCAAAAAAATGAAAGCTATATGGATACCTTGATC<br>CGACGTCTACAGCTATATTCTCGAAACCTGGAACATCTG<br>GTAGAGGAAAGGACACAGCTGTACAAGGCAGAGAGGGA<br>CAGGGCTGACAGACTTAACTTTATGTTGCTTCCAAGGCT<br>AGTGGTAAAGTCTCTGAAGGAGAAAGGCTTTGTGGAGCC<br>GGAACTATATGAGGAAGTTACAATCTACTTCAGTGACATT<br>GTAGGTTTCACTACTATCTGCAAATACAGCACCCCCATG<br>GAAGTGGTGGACATGCTTAATGACATCTATAAGAGTTTTG<br>ACCACATTGTTGATCATCATGATGTCTACAAGGTGGAAAC<br>CATCGGTGATGCGTACATGGTGGCTAGTGGTTTGCCTAA<br>GAGAAATGGCAATCGGCATGCAATAGACATTGCCAAGAT<br>GGCCTTGGAAATCCTCAGCTTCATGGGGACCTTTGAGCT<br>GGAGCATCTTCCTGGCCTCCCAATATGGATTCGCATTGG<br>AGTTCACTCTGGTCCCTGTGCTGCTGGAGTTGTGGGAAT<br>CAAGATGCCTCGTTATTGTCTATTTGGAGATACGGTCAAC<br>ACAGCCTCTAGGATGGAATCCACTGGCCTCCCTTTGAGA<br>ATTCACGTGAGTGGCTCCACCATAGCCATCCTGAAGAGA<br>ACTGAGTGCCAGTTCCTTTATGAAGTGAGAGGAGAAACA<br>TACTTAAAGGGAAGAGGAAATGAGACTACCTACTGGCTG<br>ACTGGGATGAAGGACCAGAAATTCAACCTGCCAACCCCT<br>CCTACTGTGGAGAATCAACAGCGTTTGCAAGCAGAATTT<br>TCAGACATGATTGCCAACTCTTTACAGAAAAGACAGGCA<br>GCAGGGATAAGAAGCCAAAAACCCAGACGGGTAGCCAG<br>CTATAAAAAAGGCACTCTGGAATACTTGCAGCTGAATAC<br>CACAGACAAGGAGAGCACCTATTTTTAAACCTAAATGAG<br>GTATAAGGACTCACACAAATTAAAATACAGCTGCACTGA<br>GGCAGCGACCTCAAGTGTCCTGAAAGCTTACATTTTCCT<br>GAGACCTCAATGAAGCAGAATGTACTTAGGCTTGGCTG<br>CCCTGTCTGGAACATGGACTTTCTTGCATGAATCAGATG<br>TGTGTTCTCAGTGAAATAACTACCTTCCACTCTGGAACCT<br>TATTCCAGCAGTTGTTCCAGGGAGCTTCTACCTGGAAAA<br>GAAAAGAAATGAATAGACTATCTAGAACTTGAGAAGATTT<br>TATTCTTATTTCATTTATTTTTGTTTGTTTATTTTTATCGTT<br>TTTGTTTACTGGCTTTCCTTCTGTATTCATAAGATTTTTA<br>AATTGTCATAATTATATTTAAATACCCATCTTCATTAAAG<br>TATATTTAACTCATAATTTTTGCAGAAAATATGCTATATAT<br>TAGGCAAGAATAAAAGCTAAAGGTTTCCCAAAAAAAAAA |
| 253 | Cynomolgus GUCY2C Full Length | SQVSQNCHNGSYEISVLMMDNSAFAEPLENVEDAVNEGLE<br>IVRGRLQNAGLNVTVNASFMYSDGLIHNSGDCRSSTCEGL<br>DLLRKISNAKRMGCVLMGPSCTYSTFQMYLDTELSYPMISA<br>GSFGLSCDYKETLTRLMSPARKLTYFLVNFWKTNDLPFKTY<br>SWSTSYVYKNGTESEDCFWYLNALEASVSYFSHELSPKLV<br>LRQDKEFQDILMDHNRKSNVIVMCGDPEFLYKLKGDRAVA<br>EDIVIILVDLFNDQYFEDNVTAPDYMKNVLVLTQSPGNSLLN<br>SSFSRNLSPTKRDFALAYLNGILLFGHMLKTFLENGENITTP<br>KFAHAFRNLTFEGYDGPVTLDDWGDVDSTMVLLYTSVDTK<br>KYKVLLTYDTHVNQTNPVDMSPTFTWKNSKLPNDITDRGP |

TABLE 38-continued

| SEQ ID NO: | Description | Sequence |
|---|---|---|
| | | QILMIAVFTLTGAWLLLLVALLMLRKYKKDYELRQKKWSHIP<br>PENIFPLETNETNHVSLKIDDDKRRDTIQRLRQCKYDKKRVI<br>LKDLKHNDGNFTEKQKIELNKLLQIDYYNLTKFYGTVKLDTM<br>IFGVIEYCERGSLREVLNDTISYPDGTFMDWEFKISVLYDIAK<br>GMSYLHSSKTEVHGRLKSTNCWDSRMWKITDFGCNSILP<br>PKKDLWTAPEHLRQANVSQKGDVYSYGIIAQEIILRKETFYT<br>SSCRDRNEKIFRVENSNGMKPFRPDLFLETAEEKELEVYLL<br>VKSCWEEDPEKRPDFKKIETTLAKIFGLFHDQKNESYMDTLI<br>RRLQLYSRNLEHLVEERTQLYKAERDRADRLNFMLLPRLW<br>KSLKEKGFVEPELYEEVTIYFSDIVGFTTICKYSTPMEWDM<br>LNDIYKSFDHIVDHHDVYKVETIGDAYMVASGLPKRNGNRH<br>AIDIAKMALEILSFMGTFELEHLPGLPIWIRIGVHSGPCAAGV<br>VGIKMPRYCLFGDTVNTASRMESTGLPLRIHVSGSTIAILKR<br>TECQFLYEVRGETYLKGRGNETTYWLTGMKDQKFNLPTPP<br>TVENQQRLQAEFSDMIANSLQKRQAAGIRSQKPRRVASYK<br>KGTLEYLQLNTTDKESTYF |
| 254 | Cynomolgus GUCY2C Full Length | TCACAGGTGAGTCAGAACTGCCACAATGGCAGCTATGAA<br>ATCAGCGTCCTGATGATGGACAACTCAGCCTTTGCAGAG<br>CCCCTGGAAAACGTGGAAGATGCGGTGAATGAGGGGCT<br>GGAAATAGTGAGAGGACGTCTGCAAAACGCTGGCCTAAA<br>TGTGACTGTGAATGCTTCTTTCATGTATTCGGATGGTCTG<br>ATTCATAACTCCGGCGACTGCCGGAGCAGCACCTGTGAA<br>GGCCTTGACCTACTCAGGAAAATTTCAAATGCAAAACGG<br>ATGGGCTGTGTCCTCATGGGGCCCTCATGTACATACTCC<br>ACCTTCCAGATGTACCTTGACACAGAATTGAGCTACCCC<br>ATGATCTCAGCTGGAAGTTTTGGATTGTCATGTGACTATA<br>AAGAAACCTTAACCAGGCTGATGTCTCCAGCTAGAAAGT<br>TGACATACTTCTTGGTTAACTTTTGGAAAACCAATGATCT<br>ACCCTTCAAAACTTATTCCTGGAGCACTTCGTATGTTTAC<br>AAGAATGGTACGGAGTCCGAGGACTGTTTCTGGTACCTT<br>AACGCTCTGGAGGCCAGTGTTTCCTATTTCTCCCACGAA<br>CTCAGTTTTAAGTTGGTGTTAAGACAAGATAAGGAGTTTC<br>AGGATATCTTAATGGACCACAACAGGAAAAGCAATGTGA<br>TTGTTATGTGTGGTGATCCAGAGTTCCTCTACAAGTTGAA<br>GGGTGACCGAGCAGTGGCTGAAGACATTGTCATTATTCT<br>AGTGGATCTTTTCAATGACCAGTACTTTGAGGACAATGTC<br>ACAGCCCCTGACTATATGAAAAATGTCCTTGTTCTGACG<br>CAGTCTCCTGGCAATTCCCTCCTAAATAGCTCTTTCTCCA<br>GGAATCTATCCCCAACAAAACGAGACTTTGCTCTTGCCT<br>ATTTGAATGGAATCCTGCTCTTTGGACATATGCTAAAGAC<br>ATTTCTTGAAATGGAGAAAATATTACCACCCCCAAATTT<br>GCTCATGCTTTCAGGAATCTCACTTTTGAAGGGTATGAC<br>GGTCCAGTGACCTTGGATGACTGGGGGGATGTGGACAG<br>TACCATGGTGCTTCTGTATACGTCTGTGGACACCAAGAA<br>ATACAAGGTTCTTTTGACCTATGATACCCACGTAAATCAG<br>ACCAACCCTGTGGATATGAGCCCCACATTCACTTGGAAG<br>AACTCTAAACTTCCTAATGATATTACAGACCGGGCCCT<br>CAGATCCTGATGATTGCAGTCTTCACCCTCACCGGAGCT<br>GTGGTGCTGCTCCTGCTTGTCGCTCTCCTGATGCTCAGA<br>AAATATAAAAAAGATTATGAACTTCGTCAGAAAAAATGGT<br>CCCACATTCCTCCTGAAAAATATCTTTCCTCTGGAGACCAA<br>TGAGACCAATCACGTTAGCCTGAAGATCGATGATGACAA<br>AAGACGAGATACAATCCAGAGACTACGACAGTGCAAATA<br>CGACAAAAAGCGAGTGATTCTCAAAGATCTCAAGCACAA<br>TGATGGTAATTTCACTGAAAAACAGAAGATAGAATTGAAC<br>AAGTTGCTTCAGATTGACTATTACAACCTGACCAAGTTCT<br>ATGGCACCGTGAAACTTGATACCATGATCTTCGGGGTGA<br>TAGAATACTGTGAGAGAGGATCCCTCCGGGAAGTTTTAA<br>ATGACACAATTTCCTACCCTGATGGCACATTCATGGATTG<br>GGAGTTTAAGATCTCTGTCCTGTATGACATTGCTAAGGG<br>AATGTCATATCTGCACTCCAGTAAGACAGAAGTCCATGG<br>TCGTCTGAAATCTACCAACTGCGTAGTGGACAGTAGAAT<br>GGTGGTGAAGATCACTGATTTTGGCTGCAATTCCATTTTA<br>CCTCCAAAAAAAGACCTGTGGACAGCTCCAGAGCACCTC<br>CGCCAAGCCAACGTCTCTCAGAAAGGAGATGTGTACAGC<br>TACGGGATCATCGCACAGGAGATCATCCTGCGGAAAGAA<br>ACCTTCTACACTTCGAGCTGTCGAGACCGGAACGAGAAG<br>ATTTTCAGAGTGGAAAATTCCAATGGAATGAAACCCTTCC<br>GTCCAGATTATTCTTGGAAACGGCAGAGGAAAAGAGC<br>TAGAAGTGTACCTACTTGTAAAAAGCTGTTGGGAAGAAG<br>ATCCAGAAAAGAGACCAGATTTCAAAAAAATTGAGACTAC<br>ACTTGCCAAGATATTTGGACTTTTTCATGACCAAAAAAT<br>GAAAGCTATATGGATACCTTGATCCGACGTCTACAGCTA<br>TATTCTCGAAACCTGGAACATCTGGTAGAGGAAAGGACA<br>CAGCTATACAAGGCAGAGAGGGACAGGGCTGACAGACT<br>TAACTTTATGTTGCTTCCAAGGCTAGTGGTAAAGTCTCTG |

TABLE 38-continued

| SEQ ID NO: | Description | Sequence |
|---|---|---|
| | | AAGGAGAAAGGCTTTGTAGAGCCGGAACTATATGAGGAA<br>GTTACAATCTACTTCAGTGACATTGTAGGTTTCACTACTA<br>TCTGCAAATACAGCACCCCCATGGAAGTGGTGGACATGC<br>TTAATGACATCTATAAGAGTTTTGACCACATTGTTGATCA<br>TCATGATGTCTACAAGGTGGAAACCATTGGTGATGCCTA<br>CATGGTGGCTAGTGGTTTGCCTAAGAGAAATGGCAATCG<br>GCATGCAATAGACATTGCCAAGATGGCCTTGGAAATCCT<br>CAGCTTCATGGGGACCTTTGAGCTGGAGCATCTTCCTGG<br>CCTCCCAATATGGATTCGCATTGGCGTTCACTCTGGTCC<br>CTGCGCTGCTGGAGTTGTGGGAATCAAGATGCCTCGTTA<br>TTGTCTATTTGGAGATACAGTCAACACAGCCTCTAGGAT<br>GGAATCCACTGGCCTCCCTTTGAGGATTCATGTGAGTGG<br>CTCCACCATAGCCATTCTGAAGAGAACTGAGTGCCAGTT<br>CCTGTATGAAGTGAGAGGAGAAACGTACTTAAAGGGAAG<br>AGGAAATGAGACTACCTACTGGCTGACCGGGATGAAGG<br>ACCAGAAATTCAACCTGCCAACCCCTCCTACTGTGGAGA<br>ATCAACAGCGTTTGCAAGCAGAATTTTCAGACATGATTGC<br>CAACTCTTTACAGAAAAGACAGGCGGCAGGGATAAGAAG<br>CCAAAAACCCAGACGAGTAGCCAGCTATAAAAAAGGCAC<br>TCTGGAATACTTGCAACTGAATACCACGGACAAGGAGAG<br>CACCTATTTT |
| 255 | Murine GUCY2C<br>Full Length<br>GenBank<br>Accession No.<br>NP_001120790.1 | MTSLLGLAVRLLLFQPALMVFWASQVRQNCRNGSYEISVL<br>MMDNSAYKEPMQNLREAVEEGLDIVRKRLREADLNVTVNA<br>TFIYSDGLIHKSGDCRSSTCEGLDLLREITRDHKMGCALMG<br>PSCTYSTFQMYLDTELNYPMISAGSYGLSCDYKETLTRILPP<br>ARKLMYFLVDFWKVNNASFKPFSWNSSYVYKNGSEPEDC<br>FWYLNALEAGVSYFSEVLNFKDVLRRSEQFQEILTGHNRKS<br>NVIVMCGTPESFYDVKGDLQVAEDTWILVDLFSNHYFEEN<br>TTAPEYMDNVLVLTLPSEQSTSNTSVAERFSSGRSDFSLAY<br>LEGTLLFGHMLQTFLENGENVTGPKFARAFRNLTFQGFAG<br>PVTLDDSGDIDNIMSLLYVSLDTRKYKVLMKYDTHKNKTIPV<br>AENPNFIWKNHKLPNDVPGLGPQILMIAVFTLTGILWLLLIAL<br>LVLRKYRRDHALRQKKWSHIPSENIFFPLETNETNHISLKIDD<br>DRRRDTIQRVRQCKYDKKKVILKDLKHSDGNFSEKQKIDLN<br>KLLQSDYYNLTKFYGTVKLDTRIFGWEYCERGSLREVLND<br>TISYPDGTFMDWEFKISVLNDIAKGMSYLHSSKIEVHGRLKS<br>TNCWDSRMWKITDFGCNSILPPKKDLWTAPEHLRQATIS<br>QKGDVYSFAIIAQEIILRKETFYTLSCRDHNEKIFRVENSYGK<br>PFRPDLFLETADEKELEVYLLVKSCWEEDPEKRPDFKKIES<br>TLAKIFGLFHDQKNESYMDTLIRRLQLYSRNLEHLVEERTQL<br>YKAERDRADHLNFMLLPRLWKSLKEKGIVEPELYEEVTIYF<br>SDIVGFTTICKYSTPMEWDMLNDIYKSFDQIVDHHDVYKVE<br>TIGDAYWASGLPMRNGNRHAVDISKMALDILSFIGTFELEH<br>LPGLPVWIRIGVHSGPCAAGWGIKMPRYCLFGDTVNTASR<br>MESTGLPLRIHMSSSTITILKRTDCQFLYEVRGETYLKGRGT<br>ETTYWLTGMKDQEYNLPSPPTVENQQRLQTEFSDMIVSAL<br>QKRQASGKKSRRPTRVASYKKGFLEYMQLNNSDHDSTYF |
| 256 | Murine GUCY2C<br>Full Length<br>GenBank<br>Accession No.<br>NM_001127318.1 | GACCAGTGTGGCAAGACCAGAAAGGTGCGTGGGGAAGA<br>GAAGACCAAGGGACTCTGCTAGCGACTCTCCAGAGGGG<br>CTCCCTGTGTCTCTAAAAGCGAGCAATCCAGGGGGGCAT<br>GGTGCTACGGTGAGCCAGGTCATGACGTCACTGCTGGG<br>CTTGGCTGTGCGGTTACTGCTCTTCCAGCCCGCGCTGAT<br>GGTGTTCTGGGCCTCTCAGGTGAGGCAGAACTGCCGCA<br>ATGGCAGCTACGAGATCAGCGTCCTGATGATGGACAACT<br>CAGCCTACAAAGAACCTATGCAAAACCTGAGGGAGGCTG<br>TGGAGGAAGGACTGGACATAGTGCGAAAGCGCCTGCGT<br>GAAGCCGACCTAAATGTGACTGTGAACGCGACTTTCATC<br>TACTCCGACGGTCTGATTCATAAGTCAGGTGACTGCCGG<br>AGCAGCACCTGTGAAGGCCTTGACCTACTCAGGGAGATT<br>ACAAGAGATCATAAGATGGGCTGCGCCCTCATGGGGCC<br>CTCGTGCACGTATTCCACCTTCCAGATGTACCTCGACAC<br>AGAGTTGAACTATCCCATGATTTCCGCTGGAAGTTATGG<br>ATTGTCCTGTGACTATAAGGAAACCCTAACCAGGATCCT<br>GCCTCCAGCCAGGAAGCTGATGTACTTCTTGGTCGATTT<br>CTGGAAAGTCAACAATGCATCTTTCAAACCCTTTTCCTGG<br>AACTCTTCGTATGTTTACAAGAATGGATCGGAACCTGAA<br>GATTGTTTCTGGTACCTCAATGCTCTGGAGGCTGGGGTG<br>TCCTATTTTTCTGAGGTGCTCAACTTCAAGGATGTACTGA<br>GACGCAGCGAACAGTTCCAGGAAATCTTAACAGGCCATA<br>ACAGAAAGAGCAATGTGATTGTTATGTGTGGCACGCCAG<br>AAAGCTTCTATGATGTGAAAGGTGACCTCCAAGTGGCTG<br>AAGATACTGTTGTCATCCTGGTAGATCTGTTCAGTAACCA<br>TTACTTTGAGGAGAACACCACAGCTCCTGAGTATATGGA<br>CAATGTCCTCGTCCTGACGCTGCCGTCGAACAGTCCAC<br>CTCAAACACCTCTGTCGCCGAGAGGTTTTCATCGGGGAG |

TABLE 38-continued

| SEQ ID NO: | Description | Sequence |
|---|---|---|
| | | AAGTGACTTTTCTCTCGCTTACTTGGAGGGAACCTTGCTA |
| | | TTTGGACACATGCTGCAGACGTTTCTTGAAAATGGAGAA |
| | | AATGTCACGGGTCCCAAGTTTGCTCGTGCATTCAGGAAT |
| | | CTCACTTTTCAAGGCTTTGCAGGACCTGTGACTCTGGAT |
| | | GACAGTGGGGACATTGACAACATTATGTCCCTTCTGTAT |
| | | GTGTCTCTGGATACCAGGAAATACAAGGTTCTTATGAAG |
| | | TATGACACCCACAAAAACAAAACTATTCCGGTGGCTGAG |
| | | AACCCCAACTTCATCTGGAAGAACCACAAGCTCCCCAAT |
| | | GACGTTCCTGGGCTGGGCCCTCAAATCCTGATGATTGCC |
| | | GTCTTCACGCTCACGGGGATCCTGGTAGTTCTGCTGCTG |
| | | ATTGCCCTCCTCGTGCTGAGAAAATACAGAAGAGATCAT |
| | | GCACTTCGACAGAAGAAATGGTCCCACATTCCTTCTGAA |
| | | AACATCTTTCCTCTGGAGACCAACGAGACCAACCACATC |
| | | AGCCTGAAGATTGACGATGACAGGAGACGAGACACAATC |
| | | CAGAGAGTGCGACAGTGCAAATACGACAAGAAGAAAGT |
| | | GATTCTGAAAGACCTCAAGCACAGCGACGGGAACTTCAG |
| | | TGAGAAGCAGAAGATAGACCTGAACAAGTTGCTGCAGTC |
| | | TGACTACTACAACCTGACTAAGTTCTACGGCACCGTGAA |
| | | GCTGGACACCAGGATCTTTGGGGTGGTTGAGTACTGCG |
| | | AGAGGGGATCCCTCCGGGAAGTGTTAAACGACACAATTT |
| | | CCTACCCTGACGGCACGTTCATGGATTGGGAGTTTAAGA |
| | | TCTCTGTCTTAAATGACATCGCTAAGGGGATGTCCTACCT |
| | | GCACTCCAGTAAGATTGAAGTCCACGGGCGTCTCAAATC |
| | | CACCAACTGCGTGGTGGACAGCCGCATGGTGGTGAAGA |
| | | TCACCGACTTTGGGTGCAATTCCATCCTGCCTCCAAAAA |
| | | AAGACCTGTGGACGGCCCCGGAGCACCTGCGCCAGGC |
| | | CACCATCTCTCAGAAAGGAGACGTGTACAGCTTCGCCAT |
| | | CATTGCCCAGGAGATCATCCTCCGTAAGGAGACTTTTTA |
| | | CACGCTGAGCTGTCGGGATCACAATGAGAAGATTTTCAG |
| | | AGTGGAAAATTCATACGGGAAACCTTTCCGCCCAGACCT |
| | | CTTCCTGGAGACTGCAGATGAGAAGGAGCTGGAGGTCT |
| | | ATCTACTTGTCAAAAGCTGTTGGGAGGAGGATCCAGAAA |
| | | AGAGGCCAGATTTCAAGAAAATCGAGAGCACACTGGCCA |
| | | AGATATTTGGCCTTTTCCATGACCAGAAAAACGAGTCTTA |
| | | CATGGACACCTTGATCCGACGTCTCCAGCTGTACTCTCG |
| | | AAACCTGGAACATCTGGTGGAGGAAAGGACTCAGCTGTA |
| | | CAAGGCGGAGAGGGACAGGGCTGACCACCTTAACTTCA |
| | | TGCTCCTCCCACGGCTGGTGGTAAAGTCACTGAAGGAG |
| | | AAAAGGCATCGTGGAGCCAGAGCTGTACGAAGAAGTCAC |
| | | AATCTACTTCAGTGACATTGTGGGCTTCACCACCATCTG |
| | | CAAGTATAGCACGCCCATGGAGGTGGTGGACATGCTCA |
| | | ACGACATCTACAAGAGCTTTGACCAGATTGTGGACCACC |
| | | ATGACGTCTACAAGGTAGAAACCATCGGTGACGCCTACG |
| | | TGGTGGCCAGCGGTCTGCCTATGAGAAACGGCAACCGA |
| | | CACGCGGTAGACATTTCCAAGATGGCCTTGGACATCCTC |
| | | AGCTTCATAGGGACCTTTGAGTTGGAGCATCTCCCTGGC |
| | | CTCCCCGTGTGGATCCGCATTGGAGTTCATTCTGGGCCC |
| | | TGCGCTGCTGGTGTTGTGGGGATCAAGATGCCTCGCTAT |
| | | TGCCTGTTTGGAGACACTGTCAACACTGCCTCCAGGATG |
| | | GAATCCACCGGCCTCCCCTTGAGGATTCACATGAGCAGC |
| | | TCCACCATAACCATCCTGAAGAGAACGGATTGCCAGTTC |
| | | CTGTATGAAGTGAGGGGAGAAACCTACTTAAAGGGAAGA |
| | | GGGACAGAGACCACATACTGGCTGACTGGGATGAAGGA |
| | | CCAAGAATACAACCTGCCATCCCCACCGACAGTGGAGAA |
| | | CCAACAGCGTCTGCAGACTGAGTTCTCAGACATGATCGT |
| | | TAGCGCCTTACAGAAAAGACAGGCCTCGGGCAAGAAGA |
| | | GCCGGAGGCCCACTCGGGTGGCCAGCTACAAGAAAGGC |
| | | TTTCTGGAATACATGCAGCTGAACAATTCAGACCACGATA |
| | | GCACCTATTTTTAGACCAAGTGAGGTCTGAGAACTGACA |
| | | GTAGCAACCTCCTATATCATGAATCTGTATTTTCCAGAGA |
| | | CCTCAACAACATAGACAAGCACTTAGCCTCAGTGCCCTG |
| | | ACTGGAACGTAGAACCAACCCCTCAAGTCATGTGGGTCT |
| | | GATTTTGGGTTGGTTGGTTGGTTGGTTGGTTGGTTTTGG |
| | | TTTTGTTGAGACAGAGTTTCGTGTATCCCAAGCTGGTCTC |
| | | AAACTCACTGTGTAGCAGCAGATGACTTTGGACTTCTAA |
| | | GATCATCCGTGTGTGTTCCTGACAGTGTGATGAGTGTAT |
| | | ACGTCAGAGCCCTGTCCCACAGTTCTCCATGGAGCATCA |
| | | ACCTGAATGGAGGAGCGAGGAGGGGGAATGTCCTGTGC |
| | | TGTACAGAACTTGGGGTTTTGTTCTAATTTTATCTCTGGT |
| | | TTGGTTTTGTTTTCTGGCTCCTTCCCTCTCTATGTGTGAG |
| | | AGAAGTTTTTAAATTGTCTGAATTGTATGCTAAGTAGCTT |
| | | ATCTACAAGAAAGTGTGTTTAACTAGTGATTTTTGCAGAA |
| | | ACCATGCTGGATATTAGGTAAAAAATAAAGTGTTTAGAG |
| | | TCTAAAAAAAAAAAAAAAA |

TABLE 38-continued

| SEQ ID NO: | Description | Sequence |
|---|---|---|
| 257 | GUCY2C-0074_VH CDR1 | TYWMQ |
| 258 | GUCY2C-0077_VH CDR1 | KYWMQ |
| 259 | GUCY2C-0098_VH CDR1 | SYWMH |
| 260 | GUCY2C-0104_VH CDR1 | DTYIH |
| 261 | GUCY2C-0105_VH CDR1 | DYIML |
| 262 | GUCY2C-0074_VH CDR2 | YPGDGM |
| 263 | GUCY2C-0077_VH CDR2 | YPGDGF |
| 264 | GUCY2C-0098_VH CDR2 | KPSNGL |
| 265 | GUCY2C-0104_VH CDR2 | DPANGN |
| 266 | GUCY2C-0105_VH CDR2 | NPYYGS |
| 267 | GUCY2C-1554_VH; GUCY2C-1608_VH CDR2 | KPSNEL |
| 268 | CD3-0006_VH, 2B5-1038 VH, 2B5-1039 VH, 2B5-1040 VH, CDR1 (Kabat) | DYYMT |
| 269 | CD3-0001_VH CDR2 | RNRARGYT |
| 270 | CD3-0006_VH, 2B5-1038 VH, 2B5-1039 VH, 2B5-1040 VH, CDR2 (Chothia) | RNQARGYT |
| 271 | huIGHV3-7 VH CDR1 | SYWMS |
| 272 | huIGHV3-7 VH CDR2 | KQDGSE |
| 273 | 2B5-1038 VH, 2B5-1039 VH, 2B5-1040 VH | EVQLVESGGGLVQPGGSLRLSCAASGFTFSDYYMTWVRQ APGKGLEWVAFIRNQARGYTSDHNPSVKGRFTISRDNAKN SLYLQMNSLRAEDTAVYYCARDRPSYYVLDYWGQGTTVTV SS |
| 274 | 2B5-1038 VL | DIQMTQSPSSLSASVGDRVTITCTSDQSLFNVRSGKNYLA WYQQKPGKAPKLLIYWASDRESGVPSRFSGSGSGTDFTLT ISSLQPEDFATYYCKQSYDLFTFGGGTKVEIK |
| 275 | 2B5-1039 VL | DIQMTQSPSSLSASVGDRVTITCTSSESLFNVRSGKNYLA WYQQKPGKAPKLLIYWASDRESGVPSRFSGSGSGTDFTLT ISSLQPEDFATYYCKQSYDLFTFGGGTKVEIK |
| 276 | 2B5-1040 VL | DIQMTQSPSSLSASVGDRVTITCTSSQSLFNVRSGKNYLA WYQQKPGKAPKLLIYWASDRESGVPSRFSGSGSGTDFTLT ISSLQPEDFATYYCKQSYDLFTFGGGTKVEIK |

TABLE 38-continued

| SEQ ID NO: | Description | Sequence |
|---|---|---|
| 277 | 2B5-1038 VH, 2B5-1039 VH, 2B5-1040 VH, CDR1 (Chothia) | GFTFSDY |
| 278 | 2B5-1038 VL CDR1 | TSDQSLFNVRSGKNYLA |
| 279 | 2B5-1039 VL CDR1 | TSSESLFNVRSGKNYLA |
| 280 | 2B5-1040 VL CDR1 | TSSQSLFNVRSGKNYLA |
| 281 | 2B5-1038 VL, 2B5-1039 VL, 2B5-1040 VL, CDR2 | WASDRES |
| 282 | GUCY2C-1678_Knob | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |
| 283 | GUCY2C-1678_Hole | DIQMTQSPSSLSASVGDRVTITCTSDQSLFNVRSGKNYLAWYQQKPGKAPKLLIYWASDRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| 284 | GUCY2C-1679_Knob | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG |
| 285 | GUCY2C-1679_Hole | DIQMTQSPSSLSASVGDRVTITCTSSQSLFNVRSGKNYLAWYQQKPGKAPKLLIYWASDRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRWSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG |
| 286 | GUCY2C-1680_Knob | DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQ |

TABLE 38-continued

| SEQ ID NO: | Description | Sequence |
|---|---|---|
| | | MNSLRAEDTAVYYCARDRPSYYVLDYWGQGTTVTVSSGC<br>PPCPAPEAAGAPSVFLFPPKPKDTLMISRTPEVTCVVVDVS<br>HEDPEVKFNWYVDGVEVHNAKTKPREEQYNSTYRWSVLT<br>VLHQDWLNGKEYKCKVSNKALPAPIEKTISKAKGQPREPQV<br>CTLPPSREEMTKNQVSLWCLVKGFYPSDIAVEWESNGQPE<br>NNYKTTPPVLDSDGSFFLYSKLTVDKSRWQQGNVFSCSVM<br>HEALHNHYTQKSLSLSPG |
| 287 | GUCY2C-1680_Hole | DIQMTQSPSSLSASVGDRVTITCTSSESLFNVRSGKNYLAW<br>YQQKPGKAPKLLIYWASDRESGVPSRFSGSGSGTDFTLTIS<br>SLQPEDFATYYCKQSYDLFTFGGGTKVEIKGGGGSGGGGE<br>VQLVESGGGLVQPGGSLRLSCAASGFTFSSYWMHWVRQA<br>PGKGLEWIGEIKPSNELTNVHEKFKDRFTISVDKAKNSAYLQ<br>MNSLRAEDTAVYYCTRTITTTEGYWFFDVWGQGTLVTVSS<br>GCPPCPAPEAAGAPSVFLFPPKPKDTLMISRTPEVTCVVVD<br>VSHEDPEVKFNWYVDGVEVHNAKTKPREEQYNSTYRWS<br>VLTVLHQDWLNGKEYKCKVSNKALPAPIEKTISKAKGQPRE<br>PQVYTLPPCREEMTKNQVSLSCAVKGFYPSDIAVEWESNG<br>QPENNYKTTPPVLDSDGSFFLVSKLTVDKSRWQQGNVFSC<br>SVMHEALHNHYTQKSLSLSPG |
| 288 | 2B5-1038_VL | GACATCCAGATGACCCAGTCCCCCTCTTCTCTGTCTGCC<br>TCTGTGGGCGACAGAGTGACCATCACCTGCACAAGCGA<br>CCAGTCACTGTTTAATGTCCGCAGCGGCAAAAACTATCT<br>TGCGTGGTATCAGCAGAAGCCTGGCAAGGCTCCCAAGC<br>TGCTGATCTACTGGGCCAGTGACCGAGAATCCGGCGTG<br>CCTTCCAGATTCTCCGGCTCTGGCTCTGGCACCGATTTC<br>ACCCTGACCATCTCCTCCTCCAGCCTGAGGATTTCGCC<br>ACCTACTACTGCAAACAGTCTTACGACCTTTTCACTTTTG<br>GCGGCGGAACAAAGGTGGAGATCaag |
| 289 | 2B5-1038_VH | GAAGTGCAGCTTGTTGAATCTGGCGGCGGTTTGGTTCAG<br>CCCGGTGGATCACTGCGACTCAGTTGCGCAGCTAGCGG<br>CTTCACCTTTTCTGATTACTACATGACATGGGTACGACAG<br>GCGCCAGGCAAGGGTTTGGAATGGGTAGCATTCATACG<br>CAATCAGGCACGCGGGTACACTTCAGACCACAATCCCTC<br>AGTAAAAGGAAGATTTACCATCTCAAGAGACAATGCCAA<br>AAATTCACTCTACCTGCAAATGAACTCACTTCGCGCCGA<br>GGATACCGCCGTGTATTACTGTGCCAGAGACAGACCATC<br>TTATTACGTGCTGGACTATTGGGGACAGGGCACTACAGT<br>CACCGTCAGCTCT |
| 290 | 2B5-1039_VL | GACATCCAGATGACCCAGTCCCCCTCTTCTCTGTCTGCC<br>TCTGTGGGCGACAGAGTGACCATCACCTGCACAAGCTCA<br>GAGTCACTGTTTAATGTCCGCAGCGGCAAAAACTATCTT<br>GCGTGGTATCAGCAGAAGCCTGGCAAGGCTCCCAAGCT<br>GCTGATCTACTGGGCCAGTGACCGAGAATCCGGCGTGC<br>CTTCCAGATTCTCCGGCTCTGGCTCTGGCACCGATTTCA<br>CCCTGACCATCTCCTCCTCCAGCCTGAGGATTTCGCCA<br>CCTACTACTGCAAACAGTCTTACGACCTTTTCACTTTTGG<br>CGGCGGAACAAAGGTGGAGATCAAG |
| 291 | 2B5-1039_VH | GAAGTGCAGCTTGTTGAATCTGGCGGCGGTTTGGTTCAG<br>CCCGGTGGATCACTGCGACTCAGTTGCGCAGCTAGCGG<br>CTTCACCTTTTCTGATTACTACATGACATGGGTACGACAG<br>GCGCCAGGCAAGGGTTTGGAATGGGTAGCATTCATACG<br>CAATCAGGCACGCGGGTACACTTCAGACCACAATCCCTC<br>AGTAAAAGGAAGATTTACCATCTCAAGAGACAATGCCAA<br>AAATTCACTCTACCTGCAAATGAACTCACTTCGCGCCGA<br>GGATACCGCCGTGTATTACTGTGCCAGAGACAGACCATC<br>TTATTACGTGCTGGACTATTGGGGACAGGGCACTACAGT<br>CACCGTCAGCTCT |
| 292 | 2B5-1040_VL | GACATCCAGATGACCCAGTCCCCCTCTTCTCTGTCTGCC<br>TCTGTGGGCGACAGAGTGACCATCACCTGCACAAGCTCA<br>CAGTCACTGTTTAATGTCCGCAGCGGCAAAAACTATCTT<br>GCGTGGTATCAGCAGAAGCCTGGCAAGGCTCCCAAGCT<br>GCTGATCTACTGGGCCAGTGACCGAGAATCCGGCGTGC<br>CTTCCAGATTCTCCGGCTCTGGCTCTGGCACCGATTTCA<br>CCCTGACCATCTCCTCCTCCAGCCTGAGGATTTCGCCA<br>CCTACTACTGCAAACAGTCTTACGACCTTTTCACTTTTGG<br>CGGCGGAACAAAGGTGGAGATCAAG |
| 293 | 2B5-1040_VH | GAAGTGCAGCTTGTTGAATCTGGCGGCGGTTTGGTTCAG<br>CCCGGTGGATCACTGCGACTCAGTTGCGCAGCTAGCGG<br>CTTCACCTTTTCTGATTACTACATGACATGGGTACGACAG<br>GCGCCAGGCAAGGGTTTGGAATGGGTAGCATTCATACG |

TABLE 38-continued

| SEQ ID NO: | Description | Sequence |
|---|---|---|
| | | CAATCAGGCACGCGGGTACACTTCAGACCACAATCCCTC AGTAAAAGGAAGATTTACCATCTCAAGAGACAATGCCAA AAATTCACTCTACCTGCAAATGAACTCACTTCGCGCCGA GGATACCGCCGTGTATTACTGTGCCAGAGACAGACCATC TTATTACGTGCTGGACTATTGGGGACAGGGCACTACAGT CACCGTCAGCTCT |
| 294 | GUCY2C-1696_VH | EVQLVESGGGLVQPGGSLRLSCAASGFTFSTRWMHWVRQ APGKGLEWIGEIKPSNKLTNVHEKFKDRFTISVDKAKNSAYL QMNSLRAEDTAVYYCARTITTTEGYWFLSDWGQGTLVTVSS |
| 295 | GUCY2C-1696_VL | DIQLTQSPSSLSASVGDRVTITCRASESVDYYGHSLMQWY QQKPGKAPKLLIYAASKLASGVPSRFSGSGSGTDFTLTISSL QPEDFATYYCQQTRKAYTFGQGTKLEIK |
| 296 | GUCY2C-1701_VH | EVQLVESGGGLVQPGGSLRLSCAASGFTFSSYWMHWVRQ APGKGLEWIGEIKPSNELTNVHEKFKDRFTISVDKAKNSAYL QMNSLRAEDTAVYYCTRTITTPLGYWFFDVWGQGTLVTVSS |
| 297 | GUCY2C-1701_VL | DIQLTQSPSSLSASVGDRVTITCRASESVDYYGSSLMQWY QQKPGKAPKLLIYAASKLASGVPSRFSGSGSGTDFTLTISSL QPEDFATYYCQQTRKAYTFGQGTKLEIK |
| 298 | GUCY2C-1702_VH | EVQLVESGGGLVQPGGSLRLSCAASGFTFSSYWMHWVRQ APGKGLEWIGEIKPSNELTNVHEKFKDRFTISVDKAKNSAYL QMNSLRAEDTAVYYCTRTITTPLGYWFFDVWGQGTLVTVSS |
| 299 | GUCY2C-1702_VL | DIQLTQSPSSLSASVGDRVTITCRASESVDYYGSSLMQWY QQKPGKAPKLLIYAASKLASGVPSRFSGSGSGTDFTLTISSL QPEDFATYYCQQTRKAYTFGQGTKLEIK |
| 300 | GUCY2C-1703_VH | EVQLVESGGGLVQPGGSLRLSCAASGFTFSSYWMHWVRQ APGKGLEWIGEIKPSNRWNNVHEKFKDRFTISVDKAKNSAY LQMNSLRAEDTAVYYCTRTITTTEGYWFFDVWGQGTLVTV SS |
| 301 | GUCY2C-1703_VL | DIQLTQSPSSLSASVGDRVTITCRASESVDYYGSSLMQWY QQKPGKAPKLLIYAASKLASGVPSRFSGSGSGTDFTLTISSL QPEDFATYYCQQTRKAYTFGQGTKLEIK |
| 302 | GUCY2C-1705_VH | EVQLVESGGGLVQPGGSLRLSCAASGFTFSSYWMHWVRQ APGKGLEWIGEIKPSRGFTNVHEKFKDRFTISVDKAKNSAY LQMNSLRAEDTAVYYCTRTITTTEGYWFFDVWGQGTLVTV SS |
| 303 | GUCY2C-1705_VL | DIQLTQSPSSLSASVGDRVTITCRASESVDYYGSSLMQWY QQKPGKAPKLLIYAASKLASGVPSRFSGSGSGTDFTLTISSL QPEDFATYYCQQTRKAYTFGQGTKLEIK |
| 304 | GUCY2C-1706_VH | EVQLVESGGGLVQPGGSLRLSCAASGFTFSSTWMHWVRQ APGKGLEWIGEIKPSNELTNVHEKFKDRFTISVDKAKNSAYL QMNSLRAEDTAVYYCTRTITTTEGYWFFDVWGQGTLVTVSS |
| 305 | GUCY2C-1706_VL | DIQLTQSPSSLSASVGDRVTITCRASESVDYYGSSLMQWY QQKPGKAPKLLIYAASKLASGVPSRFSGSGSGTDFTLTISSL QPEDFATYYCQQTRKAYTFGQGTKLEIK |
| 306 | GUCY2C-1708_VH | EVQLVESGGGLVQPGGSLRLSCAASGFTFSRPWMHWVRQ APGKGLEWIGEIKPSTGWTNVHEKFKDRFTISVDKAKNSAY LQMNSLRAEDTAVYYCTRTITTTTGYWFFDVWGQGTLVTV SS |
| 307 | GUCY2C-1708_VL | DIQLTQSPSSLSASVGDRVTITCRASESVDYYKHSLMQWY QQKPGKAPKLLIYAASKLASGVPSRFSGSGSGTDFTLTISSL QPEDFATYYCQQTRKAYTFGQGTKLEIK |
| 308 | GUCY2C-1710_VH | EVQLVESGGGLVQPGGSLRLSCAASGFTFSSYWMHWVRQ APGKGLEWIGEIKPSRGWTNVHEKFKDRFTISVDKAKNSAY LQMNSLRAEDTAVYYCARTITTTEGYWFFDVWGQGTLVTV SS |
| 309 | GUCY2C-1710_VL | DIQLTQSPSSLSASVGDRVTITCRASESVDYYRHSLMQWY QQKPGKAPKLLIYAASKLASGVPSRFSGSGSGTDFTLTISSL QPEDFATYYCQQTRKAYTFGQGTKLEIK |

TABLE 38-continued

| SEQ ID NO: | Description | Sequence |
|---|---|---|
| 310 | GUCY2C-1713_VH | EVQLVESGGGLVQPGGSLRLSCAASGFTFSHTWMHWVRQAPGKGLEWIGEIKPSRGFTNVHEKFKDRFTISVDKAKNSAYLQMNSLRAEDTAVYYCTRTITTTQGYWFFDVWGQGTLVTVSS |
| 311 | GUCY2C-1713_VL | DIQLTQSPSSLSASVGDRVTITCRASESVNWYGSSLMQWYQQKPGKAPKLLIYAASKLASGVPSRFSGSGSGTDFTLTISSLQPEDFATYYCQQTRKAYTFGQGTKLEIK |
| 312 | GUCY2C-1714_VH | EVQLVESGGGLVQPGGSLRLSCAASGFTFSHTWMHWVRQAPGKGLEWIGEIKPSTKYTNVHEKFKDRFTISVDKAKNSAYLQMNSLRAEDTAVYYCARTIFTREGYWFFDVWGQGTLVTVSS |
| 313 | GUCY2C-1714_VL | DIQLTQSPSSLSASVGDRVTITCRASESVNWYGSSLMQWYQQKPGKAPKLLIYAASKLASGVPSRFSGSGSGTDFTLTISSLQPEDFATYYCQQTRKAYTFGQGTKLEIK |
| 314 | GUCY2C-1715_VH | EVQLVESGGGLVQPGGSLRLSCAASGFTFSSYWMHWVRQAPGKGLEWIGEIKPSTKYTNVHEKFKDRFTISVDKAKNSAYLQMNSLRAEDTAVYYCTRTIFTNEGYWFFDVWGQGTLVTVSS |
| 315 | GUCY2C-1715_VL | DIQLTQSPSSLSASVGDRVTITCRASESVSIYGSSLMQWYQQKPGKAPKLLIYAASKLASGVPSRFSGSGSGTDFTLTISSLQPEDFATYYCQQTRKAYTFGQGTKLEIK |
| 316 | GUCY2C_ECD Peptide 1 | MKTLLLDLALWSLLFQPGWL |
| 317 | GUCY2C_ECD Peptide 2 | LDLALWSLLFQPGWLSFSSQ |
| 318 | GUCY2C_ECD Peptide 3 | WSLLFQPGWLSFSSQVSQNC |
| 319 | GUCY2C_ECD Peptide 4 | QPGWLSFSSQVSQNCHNGSY |
| 320 | GUCY2C_ECD Peptide 5 | SFSSQVSQNCHNGSYEISVL |
| 321 | GUCY2C_ECD Peptide 6 | VSQNCHNGSYEISVLMMGNS |
| 322 | GUCY2C_ECD Peptide 7 | HNGSYEISVLMMGNSAFAEP |
| 323 | GUCY2C_ECD Peptide 8 | EISVLMMGNSAFAEPLKNLE |
| 324 | GUCY2C_ECD Peptide 9 | MMGNSAFAEPLKNLEDAVNE |
| 325 | GUCY2C_ECD Peptide 10 | AFAEPLKNLEDAVNEGLEIV |
| 326 | GUCY2C_ECD Peptide 11 | LKNLEDAVNEGLEIVRGRLQ |
| 327 | GUCY2C_ECD Peptide 12 | DAVNEGLEIVRGRLQNAGLN |
| 328 | GUCY2C_ECD Peptide 13 | GLEIVRGRLQNAGLNVTVNA |
| 329 | GUCY2C_ECD Peptide 14 | RGRLQNAGLNVTVNATFMYS |
| 330 | GUCY2C_ECD Peptide 15 | NAGLNVTVNATFMYSDGLIH |
| 331 | GUCY2C_ECD Peptide 16 | VTVNATFMYSDGLIHNSGDC |
| 332 | GUCY2C_ECD Peptide 17 | TFMYSDGLIHNSGDCRSSTC |

TABLE 38-continued

| SEQ ID NO: | Description | Sequence |
|---|---|---|
| 333 | GUCY2C_ECD Peptide 18 | DGLIHNSGDCRSSTCEGLDL |
| 334 | GUCY2C_ECD Peptide 19 | NSGDCRSSTCEGLDLLRKIS |
| 335 | GUCY2C_ECD Peptide 20 | RSSTCEGLDLLRKISNAQRM |
| 336 | GUCY2C_ECD Peptide 21 | EGLDLLRKISNAQRMGCVLI |
| 337 | GUCY2C_ECD Peptide 22 | LRKISNAQRMGCVLIGPSCT |
| 338 | GUCY2C_ECD Peptide 23 | NAQRMGCVLIGPSCTYSTFQ |
| 339 | GUCY2C_ECD Peptide 24 | GCVLIGPSCTYSTFQMYLDT |
| 340 | GUCY2C_ECD Peptide 25 | GPSCTYSTFQMYLDTELSYP |
| 341 | GUCY2C_ECD Peptide 26 | YSTFQMYLDTELSYPMISAG |
| 342 | GUCY2C_ECD Peptide 27 | MYLDTELSYPMISAGSFGLS |
| 343 | GUCY2C_ECD Peptide 28 | ELSYPMISAGSFGLSCDYKE |
| 344 | GUCY2C_ECD Peptide 29 | MISAGSFGLSCDYKETLTRL |
| 345 | GUCY2C_ECD Peptide 30 | SFGLSCDYKETLTRLMSPAR |
| 346 | GUCY2C_ECD Peptide 31 | CDYKETLTRLMSPARKLMYF |
| 347 | GUCY2C_ECD Peptide 32 | TLTRLMSPARKLMYFLVNFW |
| 348 | GUCY2C_ECD Peptide 33 | MSPARKLMYFLVNFWKTNDL |
| 349 | GUCY2C_ECD Peptide 34 | KLMYFLVNFWKTNDLPFKTY |
| 350 | GUCY2C_ECD Peptide 35 | LVNFWKTNDLPFKTYSWSTS |
| 351 | GUCY2C_ECD Peptide 36 | KTNDLPFKTYSWSTSYVYKN |
| 352 | GUCY2C_ECD Peptide 37 | PFKTYSWSTSYVYKNGTETE |
| 353 | GUCY2C_ECD Peptide 38 | SWSTSYVYKNGTETEDCFWY |
| 354 | GUCY2C_ECD Peptide 39 | YVYKNGTETEDCFWYLNALE |
| 355 | GUCY2C_ECD Peptide 40 | GTETEDCFWYLNALEASVSY |
| 356 | GUCY2C_ECD Peptide 41 | DCFWYLNALEASVSYFSHEL |
| 357 | GUCY2C_ECD Peptide 42 | LNALEASVSYFSHELGFKW |
| 358 | GUCY2C_ECD Peptide 43 | ASVSYFSHELGFKWLRQDK |

TABLE 38-continued

| SEQ ID NO: | Description | Sequence |
|---|---|---|
| 359 | GUCY2C_ECD Peptide 44 | FSHELGFKWLRQDKEFQDI |
| 360 | GUCY2C_ECD Peptide 45 | GFKVVLRQDKEFQDILMDHN |
| 361 | GUCY2C_ECD Peptide 46 | LRQDKEFQDILMDHNRKSNV |
| 362 | GUCY2C_ECD Peptide 47 | EFQDILMDHNRKSNVIIMCG |
| 363 | GUCY2C_ECD Peptide 48 | LMDHNRKSNVIIMCGGPEFL |
| 364 | GUCY2C_ECD Peptide 49 | RKSNVIIMCGGPEFLYKLKG |
| 365 | GUCY2C_ECD Peptide 50 | IIMCGGPEFLYKLKGDRAVA |
| 366 | GUCY2C_ECD Peptide 51 | GPEFLYKLKGDRAVAEDIVI |
| 367 | GUCY2C_ECD Peptide 52 | YKLKGDRAVAEDIVIILVDL |
| 368 | GUCY2C_ECD Peptide 53 | DRAVAEDIVIILVDLFNDQY |
| 369 | GUCY2C_ECD Peptide 54 | EDIVIILVDLFNDQYLEDNV |
| 370 | GUCY2C_ECD Peptide 55 | ILVDLFNDQYLEDNVTAPDY |
| 371 | GUCY2C_ECD Peptide 56 | FNDQYLEDNVTAPDYMKNVL |
| 372 | GUCY2C_ECD Peptide 57 | LEDNVTAPDYMKNVLVLTLS |
| 373 | GUCY2C_ECD Peptide 58 | TAPDYMKNVLVLTLSPGNSL |
| 374 | GUCY2C_ECD Peptide 59 | MKNVLVLTLSPGNSLLNSSF |
| 375 | GUCY2C_ECD Peptide 60 | MKNVLVLTLSPGNSLLNSSF |
| 376 | GUCY2C_ECD Peptide 61 | VLTLSPGNSLLNSSFSRNLS |
| 377 | GUCY2C_ECD Peptide 62 | PGNSLLNSSFSRNLSPTKRD |
| 378 | GUCY2C_ECD Peptide 63 | LNSSFSRNLSPTKRDFALAY |
| 379 | GUCY2C_ECD Peptide 64 | SRNLSPTKRDFALAYLNGIL |
| 380 | GUCY2C_ECD Peptide 65 | PTKRDFALAYLNGILLFGHM |
| 381 | GUCY2C_ECD Peptide 66 | FALAYLNGILLFGHMLKIFL |
| 382 | GUCY2C_ECD Peptide 67 | LNGILLFGHMLKIFLENGEN |
| 383 | GUCY2C_ECD Peptide 68 | LFGHMLKIFLENGENITTPK |

TABLE 38-continued

| SEQ ID NO: | Description | Sequence |
|---|---|---|
| 384 | GUCY2C_ECD Peptide 69 | LKIFLENGENITTPKFAHAF |
| 385 | GUCY2C_ECD Peptide 70 | ENGENITTPKFAHAFRNLTF |
| 386 | GUCY2C_ECD Peptide 71 | ITTPKFAHAFRNLTFEGYDG |
| 387 | GUCY2C_ECD Peptide 72 | FAHAFRNLTFEGYDGPVTLD |
| 388 | GUCY2C_ECD Peptide 73 | RNLTFEGYDGPVTLDDWGDV |
| 389 | GUCY2C_ECD Peptide 74 | EGYDGPVTLDDWGDVDSTMV |
| 390 | GUCY2C_ECD Peptide 75 | PVTLDDWGDVDSTMVLLYTS |
| 391 | GUCY2C_ECD Peptide 76 | DWGDVDSTMVLLYTSVDTKK |
| 392 | GUCY2C_ECD Peptide 77 | DSTMVLLYTSVDTKKYKVLL |
| 393 | GUCY2C_ECD Peptide 78 | LLYTSVDTKKYKVLLTYDTH |
| 394 | GUCY2C_ECD Peptide 79 | VDTKKYKVLLTYDTHVNKTY |
| 395 | GUCY2C_ECD Peptide 80 | YKVLLTYDTHVNKTYPVDMS |
| 396 | GUCY2C_ECD Peptide 81 | TYDTHVNKTYPVDMSPTFTW |
| 397 | GUCY2C_ECD Peptide 82 | VNKTYPVDMSPTFTWKNSKL |
| 398 | GUCY2C_ECD Peptide 83 | PVDMSPTFTWKNSKLPNDIT |
| 399 | GUCY2C_ECD Peptide 84 | PTFTWKNSKLPNDITGRGPQ |
| 400 | GUCY2C_ECD Peptide 85 | KNSKLPNDITGRGPQILMIA |
| 401 | GUCY2C_ECD Peptide 86 | PNDITGRGPQILMIAVFTLT |
| 402 | GUCY2C_ECD Peptide 87 | LRKISNAQRMGCVLIGPSCT |
| 403 | GUCY2C_ECD Peptide 88 | NAQRMGCVLIGPSCTYSTFQ |
| 404 | GUCY2C_ECD Peptide 89 | GCVLIGPSCTYSTFQMYLDT |
| 405 | GUCY2C_ECD Peptide | NSGDCRSSTCEGLDLLRKISNAQRM |
| 406 | GUCY2C_ECD Peptide | RSSTCEGLDLLRKIS |
| 407 | GUCY2C-1637_VH | DIQMTQSPSSLSASVGDRVTITCTSSQSLFNVRSQKNYLAW YQQKPGKAPKLLIYWASTRESGVPSRFSGSGSGTDFTLTIS SLQPEDFATYYCKQSYDLTFGGGTKVEIKGGGGSGGGGE VQLVESGGGLVQPGGSLRLSCAASGFTFSSYWMHWVRQA PGKGLEWIGEIKPSNELTNVHEKFKDRFTISVDKAKNSAYLQ MNSLRAEDTAVYYCTRTITTTEGYWFFDWGQGTLVTVSS GGCGGHHHHHH |

TABLE 38-continued

| SEQ ID NO: | Description | Sequence |
|---|---|---|
| 408 | GUCY2C-1637_VL | DIQLTQSPSSLSASVGDRVTITCRASESVDYYGSSLLQWYQ QKPGKAPKLLIYAASKLASGVPSRFSGSGSGTDFTLTISSLQ PEDFATYYCQQTRKAYTFGQGTKLEIKGGGSGGGGEVQLV ESGGGLVQPGGSLRLSCAASGFTFSDYYMTWVRQAPGKG LEWVAFIRNQARGYTSDHNPSVKGRFTISRDNAKNSLYLQ MNSLRAEDTAVYYCARDRPSYYVLDYWGQGTTVTSSGG CGGDYKDDDDK |
| 409 | GUCY2C-1608_scFv | EVQLVESGGGLVQPGGSLRLSCAASGFTFSSYWMHWVRQ APGKGLEWIGEIKPSNELTNVHEKFKDRFTISVDKAKNSAYL QMNSLRAEDTAVYYCTRTITTTEGYWFFDVWGQGTLVTVS SGGGGSGGGGSGGGGSGDIQLTQSPSSLSASVGDRVTIT CRASESVDYYGSSLLQWYQQKPGKAPKLLIYAASKLASGV PSRFSGSGSGTDFTLTISSLQPEDFATYYCQQTRKAYTFGQ GTKLEIKTGSENLYFQ |
| 410 | CID1814 | MQLLRCFSIFSVIASVLAQEGKPIPNPLLGLDSTGGGSGGG AQAAGAHSSQVSQNCHNGSYEISVLMMGNSAFAEPLKNLE DAVNEGLEIVRGRLQNAGLNVTVNATFMYSDGLIHNSGDC RSSTCEGLDLLRKISNAQRMGCVLIGPSCTYSTFQMYLDTE LSYPMISAGSFGLSCDYKETLTRLMSPARKLMYFLVNFWKT NDLPFKTYSWSTSYVYKNGTETEDCFWYLNALEASVSYFS HELGFKWLRQDKEFQDILMDHNRKSNVIIMCGGPEFLYKL KGDRAVAEDIVIILVDLFNDQYFEDNVTAPDYMKNVLVLTLS PGNSLLNSSFSRNLSPTKRDFALAYLNGILLFGHMLKIFLEN GENITTPKFAHAFRNLTFEGYDGPVTLDDWGDVDSTMVLL YTSVDTKKYKVLLTYDTHVNKTYPVDMSPTFTWKNSKLPN DITGRGPQRTSDQASGAHHHHHHGAYPYDVPDYAGHGTS GGGGSGGTSTPSYTTSIISTETPSHSTPSSSTSITTTETPSH STPSYTSSVSTSETTSHSTPSETSSSRTTESTSYSSPSSTS SNTITETSSHSTPSTATSISSTETPSSSIPSVSSSITVTESSSH STPGATSTLTSSETSTWSTPSSTSSIMSSSYTSADTPSETS VYTSSETPSSSSPTSTSLISSSKSTSTSTPSFTSSITSTETSS YSASSYTPSVSSTASSSKNTTSSTASISSAETVSSSSSSVSS TIPSSQSTSYSTPSFSSSATSSVTPLHSTPSLPSWVTTSKTT SHITPGLTSSMSSSETYSHSTPGFTSSITSTESTSESTPSLS SSTIYSTVSTSTTAITSHFTTSETAVTPTPVTPSSLSTDIPTTS LRTLTPSSVGTSTSLTTTTDFPSIPTDISTLPTRTHIISSSPSIQ STETSSLVGTTSPTMSTVRMTLRITENTPISSFSTSIWIPET PTQTPPVLTSATGTQTSPAPTTVTFGSTDSSTSTLHKLQGD SGETIGKYIGAADSLGGSVLLLALAPLVLLSLL |
| 411 | CID1815 | MQLLRCFSIFSVIASVLAQEGKPIPNPLLGLDSTGGGSGGG AQAAGAHSSQVRQKCHNGTYEISVLMMDNSAYKEPLQNLR DAVEEGLDIVRKRLREAELNVTVNATFIYSDGLIHKSGDCRS STCEGLDLLREITRDRKMGCVLMGPSCTYSTFQMYLDTEL NYPMISAGSFGLSCDYKETLTRILPPARKLMYFLVDFWKVN NAPFKTFSWNSSYVYKNGSEPEDCFWYLNALEAGVSYFSE VLSFKDVLRRSEQFQEILMGRNRKSNVIVMCGTPETFYNVK GDLKVADDTWILVDLFSNHYFEDDTRAPEYMDNVLVLTLP PEKFIANASVSGRFPSERSDFSLAYLEGTLLFGHMLQTFLE NGESVTTPKFARAFRNLTFQGLEGPVTLDDSGDIDNIMCLL YVSLDTRKYKVLMAYDTHKNQTIPVATSPNFIWKNHRLPND VPGLGPQRTSDQASGAHHHHHHGAYPYDVPDYAGHGTSG GGGSGGTSTPSYTTSIISTETPSHSTPSSSTSITTTETPSHS TPSYTSSVSTSETTSHSTPSETSSSRTTESTSYSSPSSTSS NTITETSSHSTPSTATSISSTETPSSSIPSVSSSITVTESSSHS TPGATSTLTSSETSTWSTPSSTSSIMSSSYTSADTPSETSV YTSSETPSSSSPTSTSLISSSKSTSTSTPSFTSSITSTETSSY SASSYTPSVSSTASSSKNTTSSTASISSAETVSSSSSSVSST IPSSQSTSYSTPSFSSSATSSVTPLHSTPSLPSVWTTSKTTS HITPGLTSSMSSSETYSHSTPGFTSSITSTESTSESTPSLSS STIYSTVSTSTTAITSHFTTSETAVTPTPVTPSSLSTDIPTTSL RTLTPSSVGTSTSLTTTTDFPSIPTDISTLPTRTHIISSSPSIQ STETSSLVGTTSPTMSTVRMTLRITENTPISSFSTSIWIPET PTQTPPVLTSATGTQTSPAPTTVTFGSTDSSTSTLHKLQGD SGETIGKYIGAADSLGGSVLLLALAPLVLLSLL |
| 412 | CID1818 | MQLLRCFSIFSVIASVLAQEGKPIPNPLLGLDSTGGGSGGG AQAAGAHSSRCNNNNYMINVMLMPDSDFPSTSENLTSAV EEALSTIQNELETEGVKVTVNASFHHFRSSLYVSQGCRTST CEGVELIKQIFENGTLGCAVIGPACTYATYQMVSVETIPSLP LISVGSFGLSCDYKENLTRLLTPARKVNDFFYYFWNEIQQP FKTSTWESVYLYKKTDNSEQCLWYMNALDAGVTQFSEKLK FKDIVRTQDQFRRLVKNPKRKSNVIIMCGTPADIRQDLGTET VDKDIVIILIDLFKNTYFRNTTSARYMQNVLVLTLPPANNNFS |

TABLE 38-continued

| SEQ ID NO: | Description | Sequence |
|---|---|---|
| | | TRTTDTSLLEDDFVIGYYNAVLLFGHILKKFIFSQSPVLPTSFI
NEFRNITFEGAQGPVTLDEFGDIDNNLTLLYTTQSASDPQY
RVLMYFNTQENDTYWSTSPDFIWKSHRLPSDIPSTGPHRT
SDQASGAHHHHHGAYPYDVPDYAGHGTSGGGGSGGTS
TPSYTTSIISTETPSHSTPSSSTSITTTETPSHSTPSYTSSVS
TSETTSHSTPSETSSSRTTESTSYSSPSSTSSNTITETSSHS
TPSTATSISSTETPSSSIPSVSSSITVTESSSHSTPGATSTLT
SSETSTWSTPSSTSSIMSSSYTSADTPSETSVYTSSETPSS
SSPTSTSLISSSKSTSTPSFTSSITSTETSSYSASSYTPSV
SSTASSSKNTTSSTASISSAETVSSSSSSVSSTIPSSQSTSY
STPSFSSSATSSVTPLHSTPSLPSWVTTSKTTSHITPGLTSS
MSSSETYSHSTPGFTSSITSTESTSESTPSLSSSTIYSTVST
STTAITSHFTTSETAVTPTPVTPSSLSTDIPTTSLRTLTPSSV
GTSTSLTTTTDFPSIPTDISTLPTRTHIISSSPSIQSTETSSLV
GTTSPTMSTVRMTLRITENTPISSFSTSIWIPETPTQTPPVL
TSATGTQTSPAPTTVTFGSTDSSTSTLHKLQGDSGETIGKYI
GAADSLGGSVLLLALAPLVLLSLL |
| 413 | CID1868 | MQLLRCFSIFSVIASVLAQEGKPIPNPLLGLDSTGGGSGGG
AQAAGAHSSQVSQNCHNGSYEINVLMMGNSAFAEPLKNLE
DAVNEGLEIVRGRLQNAGLNVTVNATFMYFDGLLHNSGDC
RSSTCEGVDLLRKISNAQRMGCVLIGPSCTYSTFQMYLDTE
LSYPMISAGSFGLSCDYKETLTRLMSPARKLMYFLVNFWKT
NDLPFKTYSWSTSYVYKNGTETEDCFWYLNALEASVSYFS
HELGFKWLRQDKEFQDILMDHNRKSNVIIMCGGPEFLYKL
KGDRAVAEDIVIILVDLFNDQYFEDNVTAPDYMKNVLVLTLS
PGNSLLNSSFSRNLSPTKRDFALAYLNGILLFGHMLKIFLEN
GENITTPKFAHAFRNLTFEGYDGPVTLDDWGDVDSTMVLL
YTSVDTKKYKVLLTYDTHVNKTYPVDMSPTFTWKNSKLPN
DITGRGPQRTSDQASGAHHHHHGAYPYDVPDYAGHGTS
GGGGSGGTSTPSYTTSIISTETPSHSTPSSSTSITTTETPSH
STPSYTSSVSTSETTSHSTPSETSSSRTTESTSYSSPSSTS
SNTITETSSHSTPSTATSISSTETPSSSIPSVSSSITVTESSSH
STPGATSTLTSSETSTWSTPSSTSSIMSSSYTSADTPSETS
VYTSSETPSSSSPTSTSLISSSKSTSTPSFTSSITSTETSS
YSASSYTPSVSSTASSSKNTTSSTASISSAETVSSSSSSVSS
TIPSSQSTSYSTPSFSSSATSSVTPLHSTPSLPSVWTTSKTT
SHITPGLTSSMSSSETYSHSTPGFTSSITSTESTSESTPSLS
SSTIYSTVSTSTTAITSHFTTSETAVTPTPVTPSSLSTDIPTTS
LRTLTPSSVGTSTSLTTTTDFPSIPTDISTLPTRTHIISSSPSIQ
STETSSLVGTTSPTMSTVRMTLRITENTPISSFSTSIWIPET
PTQTPPVLTSATGTQTSPAPTTVTFGSTDSSTSTLHKLQGD
SGETIGKYIGAADSLGGSVLLLALAPLVLLSLL |
| 414 | CID1869 | MQLLRCFSIFSVIASVLAQEGKPIPNPLLGLDSTGGGSGGG
AQAAGAHSSQVSQNCHNGSYEISVLMMGDSDFAEPLKNLE
DAVNEGLEIVRGRLQNAGLNVTVNATFMYSDGLIHNSGGC
RSSTCEGLDLLRKISNAQRMGCVLIGPSCTYSTFQMYLDTE
LSYPMISAGSFGLSCDYKETLTRLMSPARKLMYFLVNFWKT
NDLPFKTYSWSTSYVYKNGTETEDCFWYLNALEASVSYFS
HELGFKWLRQDKEFQDILMDHNRKSNVIIMCGGPEFLYKL
KGDRAVAEDIVIILVDLFNDQYFEDNVTAPDYMKNVLVLTLS
PGNSLLNSSFSRNLSPTKRDFALAYLNGILLFGHMLKIFLEN
GENITTPKFAHAFRNLTFEGYDGPVTLDDWGDVDSTMVLL
YTSVDTKKYKVLLTYDTHVNKTYPVDMSPTFTWKNSKLPN
DITGRGPQRTSDQASGAHHHHHGAYPYDVPDYAGHGTS
GGGGSGGTSTPSYTTSIISTETPSHSTPSSSTSITTTETPSH
STPSYTSSVSTSETTSHSTPSETSSSRTTES
TSYSSPSSTSSNTITETSSHSTPSTATSISSTETPSSSIPSVS
SSITVTESSSHSTPGATSTLTSSETSTWSTPSSTSSIMSSSY
TSADTPSETSVYTSSETPSSSSPTSTSLISSSKSTSTPSF
TSSITSTETSSYSASSYTPSVSSTASSSKNTTSSTASISSAET
VSSSSSSVSSTIPSSQSTSYSTPSFSSSATSSVTPLHSTPSL
PSVWTTSKTTSHITPGLTSSMSSSETYSHSTPGFTSSITSTE
STSESTPSLSSSTIYSTVSTSTTAITSHFTTSETAVTPTPVTP
SSLSTDIPTTSLRTLTPSSVGTSTSLTTTTDFPSIPTDISTLPT
RTHIISSSPSIQSTETSSLVGTTSPTMSTVRMTLRITENTPIS
SFSTSIWIPETPTQTPPVLTSATGTQTSPAPTTVT
FGSTDSSTSTLHKLQGDSGETIGKYIGAADSLGGSVLLLALA
PLVLLSLL |
| 415 | CID1870 | MQLLRCFSIFSVIASVLAQEGKPIPNPLLGLDSTGGGSGGG
AQAAGAHSSQVSQNCHNGSYEISVLMMGNSAFAEPLKNLE
DAVNEGLEIVRGRLQNAGLNVTVNATFMYSDGLIHNSGDC
RSSTCEGLDLLRKISNAQRMGCVLIGPSCTYSTFQMVLDTE
LSYPMISAGSFGLSCDYKENLTRLMSPARKLMYFLVNFWKT
NDLPFKTYSWSTSYVYKNGTETEDCFWYLNALEASVSYFS |

| SEQ ID NO: | Description | Sequence |
|---|---|---|
| | | HELGFKWLRQDKEFQDILMDHNRKSNVIIMCGGPEFLYKL
KGDRAVAEDIVIILVDLFNDQYFEDNVTAPDYMKNVLVLTLS
PGNSLLNSSFSRNLSPTKRDFALAYLNGILLFGHMLKIFLEN
GENITTPKFAHAFRNLTFEGYDGPVTLDDWGDVDSTMVLL
YTSVDTKKYKVLLTYDTHVNKTYPVDMSPTFTWKNSKLPN
DITGRGPQRTSDQASGAHHHHHHGAYPYDVPDYAGHGTS
GGGGSGGTSTPSYTTSIISTETPSHSTPSSSTSITTTETPSH
STPSYTSSVSTSETTSHSTPSETSSSRTTESTSYSSPSSTS
SNTITETSSHSTPSTATSISSTETPSSSIPSVSSSITVTESSSH
STPGATSTLTSSETSTWSTPSSTSSIMSSSYTSADTPSETS
VYTSSETPSSSSPTSTSLISSSKSTSTSTPSFTSSITSTETSS
YSASSYTPSVSSTASSSKNTTSSTASISSAETVSSSSSSVSS
TIPSSQSTSYSTPSFSSSATSSVTPLHSTP
SLPSWVTTSKTTSHITPGLTSSMSSSETYSHSTPGFTSSITS
TESTSESTPSLSSSTIYSTVSTSTTAITSHFTTSETAVTPTPV
TPSSLSTDIPTTSLRTLTPSSVGTSTSLTTTTDFPSIPTDISTL
PTRTHIISSSPSIQSTETSSLVGTTSPTMSTVRMTLRITENTPI
SSFSTSIWIPETPTQTPPVLTSATGTQTSPAPTTVTFGSTD
SSTSTLHKLQGDSGETIGKYIGAADSLGGSVLLLALAPLVLL
SLL |
| 416 | CID1871 | MQLLRCFSIFSVIASVLAQEGKPIPNPLLGLDSTGGGSGGG
AQAAGAHSSQVSQNCHNGSYEISVLMMGNSAFAEPLKNLE
DAVNEGLEIVRGRLQNAGLNVTVNATFMYSDGLIHNSGDC
RSSTCEGLDLLRKISNAQRMGCVLIGPSCTYSTFQMYLDTE
LSYPMISAGSFGLSCDYKETLTRLMSPARKLMYFLVNFWKT
NDLPFKTYTWSTSYVYKNGTETEDCFWYLNALEASVSYFS
HELGFKWLRQDKEFQDILMDHNRKSNVIIMCGGPEFLYKL
KGDRAVAEDIVIILVDLFNDQYFEDNVTAPDYMKNVLVLTLS
PGNSLLNSSFSRNLSPTKRDFALAYLNGILLFGHMLKIFLEN
GENITTPKFAHAFRNLTFEGYDGPVTLDDWGDVDSTMVLL
YTSVDTKKYKVLLTYDTHVNKTYPVDMSPTFTWKNSKLPN
DITSRGPQRTSDQASGAHHHHHHGAYPYDVPDYAGHGTS
GGGGSGGTSTPSYTTSIISTETPSHSTPSSSTSITTTETPSH
STPSYTSSVSTSETTSHSTPSETSSSRTTESTSYSSPSSTS
SNTITETSSHSTPSTATSISSTETPSSSIPSVSSSITVTESSSH
STPGATSTLTSSETSTWSTPSSTSSIMSSSYTSADTPSETS
VYTSSETPSSSSPTSTSLISSSKSTSTSTPSFTSSITSTETSS
YSASSYTPSVSSTASSSKNTTSSTASISSAETVSSSSSSVSS
TIPSSQSTSYSTPSFSSSATSSVTPLHSTPSLPSWVTTSKTT
SHITPGLTSSMSSSETYSHSTPGFTSSITSTESTSESTPSLS
SSTIYSTVSTSTTAITSHFTTSETAVTPTPVTPSSLSTDIPTTS
LRTLTPSSVGTSTSLTTTTDFPSIPTDISTLPTRTHIISSSPSIQ
STETSSLVGTTSPTMSTVRMTLRITENTPISSFSTSIWIPET
PTQTPPVLTSATGTQTSPAPTTVTFGSTDSSTSTLHKLQGD
SGETIGKYIGAADSLGGSVLLLALAPLVLLSLL |
| 417 | CID1872 | MQLLRCFSIFSVIASVLAQEGKPIPNPLLGLDSTGGGSGGG
AQAAGAHSSQVSQNCHNGSYEISVLMMGNSAFAEPLKNLE
DAVNEGLEIVRGRLQNAGLNVTVNATFMYSDGLIHNSGDC
RSSTCEGLDLLRKISNAQRMGCVLIGPSCTYSTFQMYLDTE
LSYPMISAGSFGLSCDYKETLTRLMSPARKLMYFLVNFWKT
NDLPFKTYSWSTSYVYKNGTETEDCFWYLNALEASVSYFS
HELGFKWLRQDKEFRDILMDHNRKSNVIIMCGGPAF
LYKLKGTRAVAEDIVIILVDLFNDQYFRDNVTAPDYMKNVLV
LTLSPGNSLLNSSFSRNLSPTKRDFALAYLNGILLFGHMLKIF
LENGENITTPKFAHAFRNLTFEGYDGPVTLDDWGDVDSTM
VLLYTSVDTKKYKVLLTYDTHVNKTYPVDMSPTFTWKNSKL
PNDITGRGPQRTSDQASGAHHHHHHGAYPYDVPDYAGHG
TSGGGGSGGTSTPSYTTSIISTETPSHSTPSSSTSITTTETP
SHSTPSYTSSVSTSETTSHSTPSETSSSRTTESTSYSSPSS
TSSNTITETSSHSTPSTATSISSTETPSSSIPSVSSSITVTESS
SHSTPGATSTLTSSETSTWSTPSSTSSIMSSSYTSADTPSE
TSVYTSSETPSSSSPTSTSLISSSKSTSTSTPSFTSSITSTET
SSYSASSYTPSVSSTASSSKNTTSSTASISSAETVSSSSSSV
SSTIPSSQSTSYSTPSFSSSATSSVTPLHSTPSLPSWVTTSK
TTSHITPGLTSSMSSSETYSHSTPGFTSSITSTESTSESTPS
LSSSTIYSTVSTSTTAITSHFTTSETAVTPTPVTPSSLSTDIPT
TSLRTLTPSSVGTSTSLTTTTDFPSIPTDISTLPTRTHIISSSP
SIQSTETSSLVGTTSPTMSTVRMTLRITENTPISSFSTSIWIP
ETPTQTPPVLTSATGTQTSPAPTTVTFGSTDSSTSTLHKLQ
GDSGETIGKYIGAADSLGGSVLLLALAPLVLLSLL |
| 418 | CID1873 | MQLLRCFSIFSVIASVLAQEGKPIPNPLLGLDSTGGGSGGG
AQAAGAHSSQVSQNCHNGSYEISVLMMGNSAFAEPLKNLE
DAVNEGLEIVRGRLQNAGLNVTVNATFMYSDGLIHNSGDC
RSSTCEGLDLLRKISNAQRMGCVLIGPSCTYSTFQMYLDTE |

TABLE 38-continued

| SEQ ID NO: | Description | Sequence |
|---|---|---|
| | | LSYPMISAGSFGLSCDYKETLTRLMSPARKLMYFLVNFWKT
NDLPFKTYSWSTSYVYKNGTETEDCFWYLNALEASVSYFS
HELGFKWLRQDKEFQDILMDHNRKSNVIIMCGGPEFLYKL
KGDRAVAEDIVIILVDLFNDQYFEDNVTAPDYMKNVLVLTLS
PGNSLLNSSFSRNLSPTKRDFALAYLNGILLFGHMLKIFLEN
GENITTPKFAHEFRNITFEGYDGPVTLDDWGDVDSTMVLLY
TSVDTKKYKVLLTYDTHVNKTYPVDMSPTFTWKNSKLPNDI
TGRGPQRTSDQASGAHHHHHHGAYPYDVPDYAGHGTSG
GGGSGGTSTPSYTTSIISTETPSHSTPSSSTSITTTETPSHS
TPSYTSVSTSETTSHSTPSETSSSRTTESTSYSSPSSTSS
NTITETSSHSTPSTATSISSTETPSSSIPSVSSSITVTESSSHS
TPGATSTLTSSETSTWSTPSSTSSIMSSSYTSADTPSETSV
YTSSETPSSSSPTSTSLISSSKSTSTSTPSFTSSITSTETSSY
SASSYTPSVSSTASSSKNTTSSTASISSAETVSSSSSSVSST
IPSSQSTSYSTPSFSSSATSSVTPLHSTPSLPSWVTTSKTTS
HITPGLTSSMSSSETYSHSTPGFTSSITSTESTSESTPSLSS
STIYSTVSTSTTAITSHFTTSETAVTPTPVTPSSLSTDIPTTSL
RTLTPSSVGTSTSLTTTTDFPSIPTDISTLPTRTHIISSSPSIQ
STETSSLVGTTSPTMSTVRMTLRITENTPISSFSTSIWIPET
PTQTPPVLTSATGTQTSPAPTTVTFGSTDSSTSTLHKLQGD
SGETIGKYIGAADSLGGSVLLLALAPLVLLSLL |
| 419 | CID1874 | MQLLRCFSIFSVIASVLAQEGKPIPNPLLGLDSTGGGSGGG
AQAAGAHSSQVSQNCHNGSYEISVLMMGNSAFAEPLKNLE
DAVNEGLEIVRGRLQNAGLNVTVNATFMYSDGLIHNSGDC
RTSTCEGVELIKQIFENGTLGCVLIGPSCTYSTFQMYLDTEL
SYPMISAGSFGLSCDYKETLTRLMSPARKLMYFLVNFWKTN
DLPFKTYSWSTSYVYKNGTETEDCFWYLNALEASVSYFSH
ELGFKWLRQDKEFQDILMDHNRKSNVIIMCGGPEFLYKLK
GDRAVAEDIVIILVDLFNDQYFEDNVTAPDYMKNVLVLTLSP
GNSLLNSSFSRNLSPTKRDFALAYLNGILLFGHMLKIFLENG
ENITTPKFAHAFRNLTFEGYDGPVTLDDWGDVDSTMVLLYT
SVDTKKYKVLLTYDTHVNKTYPVDMSPTFTWKNSKLPNDIT
GRGPQRTSDQASGAHHHHHHGAYPYDVPDYAGHGTSGG
GSGGTSTPSYTTSIISTETPSHSTPSSSTSITTTETPSHSTP
SYTSVSTSETTSHSTPSETSSSRTTESTSYSSPSSTSSNTI
TETSSHSTPSTATSISSTETPSSSIPSVSSSITVTESSSHSTP
GATSTLTSSETSTWSTPSSTSSIMSSSYTSADTPSETSVYT
SSETPSSSSPTSTSLISSSKSTSTSTPSFTSSITSTETSSYSA
SSYTPSVSSTASSSKNTTSSTASISSAETVSSSSSSVSSTIP
SSQSTSYSTPSFSSSATSSVTPLHSTPSLPSWVTTSKTTSHI
TPGLTSSMSSSETYSHSTPGFTSSITSTESTSESTPSLSSST
IYSTVSTSTTAITSHFTTSETAVTPTPVTPSSLSTDIPTTSLRT
LTPSSVGTSTSLTTTTDFPSIPTDISTLPTRTHIISSSPSIQST
ETSSLVGTTSPTMSTVRMTLRITENTPISSFSTSIWIPETPT
QTPPVLTSATGTQTSPAPTTVTFGSTDSSTSTLHKLQGDSG
ETIGKYIGAADSLGGSVLLLALAPLVLLSLL |
| 420 | CID1875 | MQLLRCFSIFSVIASVLAQEGKPIPNPLLGLDSTGGGSGGG
AQAAGAHSSQVSQNCHNGSYEISVLMMGNSAFAEPLKNLE
DAVNEGLEIVRGRLQNAGLNVTVNATFMYSDGLIHNSGDC
RSSTCEGLDLLRKISNAQRMGCVLIGPSCTYSTFQMYLDTE
LSYPMISAGSFGLSCDYKETLTRLMSPARKLMYFLVNFWNE
IQQPFKTSTWESSYVYKNGTETEDCFWYLNALEASVSYFS
HELGFKWLRQDKEFQDILMDHNRKSNVIIMCGGPEFLYKL
KGDRAVAEDIVIILVDLFNDQYFEDNVTAPDYMKNVLVLTLS
PGNSLLNSSFSRNLSPTKRDFALAYLNGILLFGHMLKIFLEN
GENITTPKFAHAFRNLTFEGYDGPVTLDDWGDVDSTMVLL
YTSVDTKKYKVLLTYDTHVNKTYPVDMSPTFTWKNSKLPN
DITGRGPQRTSDQASGAHHHHHHGAYPYDVPDYAGHGTS
GGGGSGGTSTPSYTTSIISTETPSHSTPSSSTSITTTETPSH
STPSYTSVSTSETTSHSTPSETSSSRTTESTSYSSPSSTS
SNTITETSSHSTPSTATSISSTETPSSSIPSVSSSITVTESSSH
STPGATSTLTSSETSTWSTPSSTSSIMSSSYTSADTPSETS
VYTSSETPSSSSPTSTSLISSSKSTSTSTPSFTSSITSTETSS
YSASSYTPSVSSTASSSKNTTSSTASISSAETVSSSSSSVSS
TIPSSQSTSYSTPSFSSSATSSVTPLHSTPSLPSWVTTSKTT
SHITPGLTSSMSSSETYSHSTPGFTSSITSTESTSESTPSLS
SSTIYSTVSTSTTAITSHFTTSETAVTPTPVTPSSLSTDIPTTS
LRTLTPSSVGTSTSLTTTTDFPSIPTDISTLPTRTHIISSSPSIQ
STETSSLVGTTSPTMSTVRMTLRITENTPISSFSTSIWIPET
PTQTPPVLTSATGTQTSPAPTTVTFGSTDSSTSTLHKLQGD
SGETIGKYIGAADSLGGSVLLLALAPLVLLSLL |
| 421 | CID1876 | MQLLRCFSIFSVIASVLAQEGKPIPNPLLGLDSTGGGSGGG
AQAAGAHSSQVSQNCHNGSYEISVLMMGNSAFAEPLKNLE
DAVNEGLEIVRGRLQNAGLNVTVNATFMYSDGLIHNSGDC |

TABLE 38-continued

| SEQ ID NO: | Description | Sequence |
|---|---|---|
| | | RSSTCEGLDLLRKISNAQRMGCVLIGPSCTYSTFQMYLDTE LSYPMISAGSFGLSCDYKETLTRLMSPARKLMYFLVNFWKT NDLPFKTYSWSTSYVYKKTDNSEQCFWYLNALEASVSYFS HELGFKWLRQDKEFQDILMDHNRKSNVIIMCGGPEFLYKL KGDRAVAEDIVIILVDLFNDQYFEDNVTAPDYMKNVLVLTLS PGNSLLNSSFSRNLSPTKRDFALAYLNGILLFGHMLKIFLEN GENITTPKFAHAFRNLTFEGYDGPVTLDDWGDVDSTMVLL YTSVDTKKYKVLLTYDTHVNKTYPVDMSPTFTWKNSKLPN DITGRGPQRTSDQASGAHHHHHHGAYPYDVPDYAGHGTS GGGGSGGTSTPSYTTSIISTETPSHSTPSSSTSITTTETPSH STPSYTSSVSTSETTSHSTPSETSSSRTTESTSYSSPSSTS SNTITETSSHSTPSTATSISSTETPSSSIPSVSSSITVTESSSH STPGATSTLTSSETSTWSTPSSTSSIMSSSYTSADTPSETS VYTSSETPSSSSPTSTSLISSSKSTSTSTPSFTSSITSTETSS YSASSYTPSVSSTASSSKNTTSSTASISSAETVSSSSSSVSS TIPSSQSTSYSTPSFSSSATSSVTPLHSTP SLPSWVTTSKTTSHITPGLTSSMSSSETYSHSTPGFTSSITS TESTSESTPSLSSSTIYSTVSTSTTAITSHFTTSETAVTPTPV TPSSLSTDIPTTSLRTLTPSSVGTSTSLTTTTDFPSIPTDISTL PTRTHIISSSPSIQSTETSSLVGTTSPTMSTVRMTLRITENTPI SSFSTSIWIPETPTQTPPVLTSATGTQTSPAPTTVTFGSTD SSTSTLHKLQGDSGETIGKYIGAADSLGGSVLLLALAPLVLL SLL |
| 422 | CID1877 | MQLLRCFSIFSVIASVLAQEGKPIPNPLLGLDSTGGGSGGG AQAAGAHSSQVSQNCHNGSYEISVLMMGNSAFAEPLKNLE DAVNEGLEIVRGRLQNAGLNVTVNATFMYSDGLIHNSGDC RSSTCEGLDLLRKISNAQRMGCVLIGPSCTYSTFQMYLDTE LSYPMISAGSFGLSCDYKETLTRLMSPARKLMYFLVNFWKT NDLPFKTYSWSTSYVYKNGTETEDCFWYLNALEASVSYFS HELKFKDIVRTQKEFQDILMDHNRKSNVIIMCGGPEF LYKLKGDRAVAEDIVIILVDLFNDQYFEDNVTAPDYMKNVLV LTLSPGNSLLNSSFSRNLSPTKRDFALAYLNGILLFGHMLKIF LENGENITTPKFAHAFRNLTFEGYDGPVTLDDWGDVDSTM VLLYTSVDTKKYKVLLTYDTHVNKTYPVDMSPTFTWKNSKL PNDITGRGPQRTSDQASGAHHHHHHGAYPYDVPDYAGHG TSGGGGSGGTSTPSYTTSIISTETPSHSTPSSSTSITTTETP SHSTPSYTSSVSTSETTSHSTPSETSSSRTTESTSYSSPSS TSSNTITETSSHSTPSTATSISSTETPSSSIPSVSSSITVTESS SHSTPGATSTLTSSETSTWSTPSSTSSIMSSSYTSADTPSE TSVYTSSETPSSSSPTSTSLISSSKSTSTSTPSFTSSITSTET SSYSASSYTPSVSSTASSSKNTTSSTASISSAETVSSSSSSV SSTIPSSQSTSYSTPSFSSSATSSVTPLHSTPSLPSWVTTSK TTSHITPGLTSSMSSSETYSHSTPGFTSSITSTESTSESTPS LSSSTIYSTVSTSTTAITSHFTTSETAVTPTPVTPSSLSTDIPT TSLRTLTPSSVGTSTSLTTTTDFPSIPTDISTLPTRTHIISSSP SIQSTETSSLVGTTSPTMSTVRMTLRITENTPISSFSTSIWIP ETPTQTPPVLTSATGTQTSPAPTTVTFGSTDSSTSTLHKLQ GDSGETIGKYIGAADSLGGSVLLLALAPLVLLSLL |
| 423 | CID1878 | MQLLRCFSIFSVIASVLAQEGKPIPNPLLGLDSTGGGSGGG AQAAGAHSSQVSQNCHNGSYEISVLMMGNSAFAEPLKNLE DAVNEGLEIVRGRLQNAGLNVTVNATFMYSDGLIHNSGDC RSSTCEGLDLLRKISNAQRMGCVLIGPSCTYSTFQMYLDTE LSYPMISAGSFGLSCDYKETLTRLMSPARKLMYFLVNFWKT NDLPFKTYSWSTSYVYKNGTETEDCFWYLNALEASVSYFS HELGFKWLRQDDQFRRLVKNPKRKSNVIIMCGGPEFLYKL KGDRAVAEDIVIILVDLFNDQYFEDNVTAPDYMKNVLVLTLS PGNSLLNSSFSRNLSPTKRDFALAYLNGILLFGHMLKIFLEN GENITTPKFAHAFRNLTFEGYDGPVTLDDWGDVDSTMVLL YTSVDTKKYKVLLTYDTHVNKTYPVDMSPTFTWKNSKLPN DITGRGPQRTSDQASGAHHHHHHGAYPYDVPDYAGHGTS GGGGSGGTSTPSYTTSIISTETPSHSTPSSSTSITTTETPSH STPSYTSSVSTSETTSHSTPSETSSSRTTESTSYSSPSSTS SNTITETSSHSTPSTATSISSTETPSSSIPSVSSSITVTESSSH STPGATSTLTSSETSTWSTPSSTSSIMSSSYTSADTPSETS VYTSSETPSSSSPTSTSLISSSKSTSTSTPSFTSSITSTETSS YSASSYTPSVSSTASSSKNTTSSTASISSAETVSSSSSSVSS TIPSSQSTSYSTPSFSSSATSSVTPLHSTPSLPSWVTTSKTT SHITPGLTSSMSSSETYSHSTPGFTSSITSTESTSESTPSLS SSTIYSTVSTSTTAITSHFTTSETAVTPTPVTPSSLSTDIPTTS LRTLTPSSVGTSTSLTTTTDFPSIPTDISTLPTRTHIISSSPSIQ STETSSLVGTTSPTMSTVRMTLRITENTPISSFSTSIWIPET PTQTPPVLTSATGTQTSPAPTTVTFGSTDSSTSTLHKLQGD SGETIGKYIGAADSLGGSVLLLALAPLVLLSLL |

TABLE 38-continued

| SEQ ID NO: | Description | Sequence |
|---|---|---|
| 424 | CID1879 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLDLLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGTETVDKDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSPSFTSSITSTETSS<br>YSASSYTPSVSSTASSSKNTTSSTASISSAETVSSSSSSVSS<br>TIPSSQSTSYSTPSFSSSATSSVTPLHSTPSLPSWVTTSKTT<br>SHITPGLTSSMSSSETYSHSTPGFTSSITSTESTSESTPSLS<br>SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 425 | CID1880 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLDLLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFRNTTSARYMQNVLVLTLSP<br>GNSLLNSSFSRNLSPTKRDFALAYLNGILLFGHMLKIFLENG<br>ENITTPKFAHAFRNLTFEGYDGPVTLDDWGDVDSTMVLLYT<br>SVDTKKYKVLLTYDTHVNKTYPVDMSPTFTWKNSKLPNDIT<br>GRGPQRTSDQASGAHHHHHHGAYPYDVPDYAGHGTSGG<br>GGSGGTSTPSYTTSIISTETPSHSTPSSSTSITTTETPSHSTP<br>SYTSSVSTSETTSHSTPSETSSSRTTESTSYSSPSSTSSNTI<br>TETSSHSTPSTATSISSTETPSSSIPSVSSSITVTESSSHSTP<br>GATSTLTSSETSTWSTPSSTSSIMSSSYTSADTPSETSVYT<br>SSETPSSSSPTSTSLISSSKSTSTSPSFTSSITSTETSSYSA<br>SSYTPSVSSTASSSKNTTSSTASISSAETVSSSSSSVSSTIP<br>SSQSTSYSTPSFSSSATSSVTPLHSTPSLPSWVTTSKTTSHI<br>TPGLTSSMSSSETYSHSTPGFTSSITSTESTSESTPSLSSST<br>IYSTVSTSTTAITSHFTTSETAVTPTPVTPSSLSTDIPTTSLRT<br>LTPSSVGTSTSLTTTTDFPSIPTDISTLPTRTHIISSSPSIQST<br>ETSSLVGTTSPTMSTVRMTLRITENTPISSFSTSIWIPETPT<br>QTPPVLTSATGTQTSPAPTTVTFGSTDSSTSTLHKLQGDSG<br>ETIGKYIGAADSLGGSVLLLALAPLVLLSLL |
| 426 | CID1881 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLDLLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSASDPQYRVLMYFNTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSPSFTSSITSTETSS<br>YSASSYTPSVSSTASSSKNTTSSTASISSAETVSSSSSSVSS<br>TIPSSQSTSYSTPSFSSSATSSVTPLHSTP<br>SLPSWVTTSKTTSHITPGLTSSMSSSETYSHSTPGFTSSITS<br>TESTSESTPSLSSSTIYSTVSTSTTAITSHFTTSETAVTPTPV<br>TPSSLSTDIPTTSLRTLTPSSVGTSTSLTTTTDFPSIPTDISTL<br>PTRTHIISSSPSIQSTETSSLVGTTSPTMSTVRMTLRITENTPI |

| SEQ ID NO: | Description | Sequence |
|---|---|---|
| | | SSFSTSIWIPETPTQTPPVLTSATGTQTSPAPTTVTFGSTD SSTSTLHKLQGDSGETIGKYIGAADSLGGSVLLLALAPLVLL SLL |
| 427 | CID1939 | MQLLRCFSIFSVIASVLAQEGKPIPNPLLGLDSTGGGSGGG AQAAGAHSSSRCNNNNYMINVMLMPDSDFPSTSENLTSAV EEALSTIQNELETEGVKVTVNASFHHFRSSLYVSQGCRSST CEGLDLLRKISNAQRMGCAVIGPACTYATYQMVSVETIPSL PLISVGSFGLSCDYKENLTRLLTPARKVNDFFYYFWNEIQQ PFKTSTWESVYLYKKTDNSEQCLWYMNALDAGVTQFSEKL KFKDIVRTQDQFRRLVKNPKRKSNVIIMCGTPADIRQDLGTE TVDKDIVIILIDLFKNTYFRNTTSARYMQNVLVLTLPPANNNF STRTTDTSLLEDDFVIGYYNAVLLFGHILKKFIFSQSPVLPTS FINEFRNITFEGAQGPVTLDEFGDIDNNLTLLYTTQSASDPQ YRVLMYFNTQENDTYWSTSPDFIWKSHRLPSDIPSTGPHR TSDQASGAHHHHHHGAYPYDVPDYAGHGTSGGGGSGGT STPSYTTSIISTETPSHSTPSSSTSITTTETPSHSTPSYTSSV STSETTSHSTPSETSSSRTTESTSYSSPSSTSSNTITETSSH STPSTATSISSTETPSSSIPSVSSSITVTESSSHSTPGATSTL TSSETSTWSTPSSTSSIMSSSYTSADTPSETSVYTSSETPS SSSPTSTSLISSSKSTSTSTPSFTSSITSTETSSYSASSYTPS VSSTASSSKNTTSSTASISSAETVSSSSSSVSSTIPSSQSTS YSTPSFSSSATSSVTPLHSTPSLPSWVTTSKTTSHITPGLTS SMSSSETYSHSTPGFTSSITSTESTSESTPSLSSSTIYSTVS TSTTAITSHFTTSETAVTPTPVTPSSLSTDIPTTSLRTLTPSS VGTSTSLTTTTDFPSIPTDISTLPTRTHIISSSPSIQSTETSSL VGTTSPTMSTVRMTLRITENTPISSFSTSIWIPETPTQTPPV LTSATGTQTSPAPTTVTFGSTDSSTSTLHKLQGDSGETIGK YIGAADSLGGSVLLLALAPLVLLSLL |
| 428 | CID1940 | MQLLRCFSIFSVIASVLAQEGKPIPNPLLGLDSTGGGSGGG AQAAGAHSSSRCNNNNYMINVMLMPDSDFPSTSENLTSAV EEALSTIQNELETEGVKVTVNASFHHFRSSLYVSQGCRSST CEGLDLLRKISENGTLGCAVIGPACTYATYQMVSVETIPSLP LISVGSFGLSCDYKENLTRLLTPARKVNDFFYYFWNEIQQP FKTSTWESVYLYKKTDNSEQCLWYMNALDAGVTQFSEKLK FKDIVRTQDQFRRLVKNPKRKSNVIIMCGTPADIRQDLGTET VDKDIVIILIDLFKNTYFRNTTSARYMQNVLVLTLPPANNNFS TRTTDTSLLEDDFVIGYYNAVLLFGHILKKFIFSQSPVLPTSFI NEFRNITFEGAQGPVTLDEFGDIDNNLTLLYTTQSASDPQY RVLMYFNTQENDTYWSTSPDFIWKSHRLPSDIPSTGPHRT SDQASGAHHHHHHGAYPYDVPDYAGHGTSGGGGSGGTS TPSYTTSIISTETPSHSTPSSSTSITTTETPSHSTPSYTSSVS TSETTSHSTPSETSSSRTTESTSYSSPSSTSSNTITETSSHS TPSTATSISSTETPSSSIPSVSSSITVTESSSHSTPGATSTLT SSETSTWSTPSSTSSIMSSSYTSADTPSETSVYTSSETPSS SSPTSTSLISSSKSTSTSTPSFTSSITSTETSSYSASSYTPSV SSTASSSKNTTSSTASISSAETVSSSSSSVSSTIPSSQSTSY STPSFSSSATSSVTPLHSTPSLPSWVTTSKTTSHITPGLTSS MSSSETYSHSTPGFTSSITSTESTSESTPSLSSSTIYSTVST STTAITSHFTTSETAVTPTPVTPSSLSTDIPTTSLRTLTPSSV GTSTSLTTTTDFPSIPTDISTLPTRTHIISSSPSIQSTETSSLV GTTSPTMSTVRMTLRITENTPISSFSTSIWIPETPTQTPPVL TSATGTQTSPAPTTVTFGSTDSSTSTLHKLQGDSGETIGKYI GAADSLGGSVLLLALAPLVLLSLL |
| 429 | CID1941 | MQLLRCFSIFSVIASVLAQEGKPIPNPLLGLDSTGGGSGGG AQAAGAHSSQVSQNCHNGSYEINVLMMGNSAFAEPLKNLE DAVNEGLEIVRGRLQNAGLNVTVNATFMYSDGLIHNSGDC RSSTCEGLDLLRKISNAQRMGCVLIGPSCTYSTFQMYLDTE LSYPMISAGSFGLSCDYKETLTRLMSPARKLMYFLVNFWKT NDLPFKTYSWSTSYVYKNGTETEDCFWYLNALEASVSYFS HELGFKWLRQDKEFQDILMDHNRKSNVIIMCGGPEFLYKL KGDRAVAEDIVIILVDLFNDQYFEDNVTAPDYMKNVLVLTLS PGNSLLNSSFSRNLSPTKRDFALAYLNGILLFGHMLKIFLEN GENITTPKFAHAFRNLTFEGYDGPVTLDDWGDVDSTMVLL YTSVDTKKYKVLLTYDTHVNKTYPVDMSPTFTWKNSKLPN DITGRGPQRTSDQASGAHHHHHHGAYPYDVPDYAGHGTS GGGGSGGTSTPSYTTSIISTETPSHSTPSSSTSITTTETPSH STPSYTSSVSTSETTSHSTPSETSSSRTTESTSYSSPSSTS SNTITETSSHSTPSTATSISSTETPSSSIPSVSSSITVTESSH STPGATSTLTSSETSTWSTPSSTSSIMSSSYTSADTPSETS VYTSSETPSSSSPTSTSLISSSKSTSTSTPSFTSSITSTETSS YSASSYTPSVSSTASSSKNTTSSTASISSAETVSSSSSSVSS TIPSSQSTSYSTPSFSSSATSSVTPLHSTPSLPSWVTTSKTT SHITPGLTSSMSSSETYSHSTPGFTSSITSTESTSESTPSLS SSTIYSTVSTSTTAITSHFTTSETAVTPTPVTPSSLSTDIPTTS |

| SEQ ID NO: | Description | Sequence |
|---|---|---|
| | | LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 430 | CID1942 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYFDGLIHNSGDC<br>RSSTCEGLDLLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSTPSFTSSITSTETSS<br>YSASSYTPSVSSTASSSKNTTSSTASISSAETVSSSSSSVSS<br>TIPSSQSTSYSTPSFSSSATSSVTPLHSTPSLPSWVTTSKTT<br>SHITPGLTSSMSSSETYSHSTPGFTSSITSTESTSESTPSLS<br>SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 431 | CID1943 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLLHNSGDC<br>RSSTCEGLDLLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSTPSFTSSITSTETSS<br>YSASSYTPSVSSTASSSKNTTSSTASISSAETVSSSSSSVSS<br>TIPSSQSTSYSTPSFSSSATSSVTPLHSTPSLPSWVTTSKTT<br>SHITPGLTSSMSSSETYSHSTPGFTSSITSTESTSESTPSLS<br>SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 432 | CID1944 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RTSTCEGLDLLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSTPSFTSSITSTETSS<br>YSASSYTPSVSSTASSSKNTTSSTASISSAETVSSSSSSVSS<br>TIPSSQSTSYSTPSFSSSATSSVTPLHSTPSLPSWVTTSKTT<br>SHITPGLTSSMSSSETYSHSTPGFTSSITSTESTSESTPSLS |

US 11,525,010 B2

TABLE 38-continued

| SEQ ID NO: | Description | Sequence |
|---|---|---|
| | | SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 433 | CID1945 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGVDLLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSPSFTSSITSTETSS<br>YSASSYTPSVSSTASSSKNTTSSTASISSAETVSSSSSSVSS<br>TIPSSQSTSYSTPSFSSSATSSVTPLHSTPSLPSWVTTSKTT<br>SHITPGLTSSMSSSETYSHSTPGFTSSITSTESTSESTPSLS<br>SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 434 | CID1946 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLELLRKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSPSFTSSITSTETSS<br>YSASSYTPSVSSTASSSKNTTSSTASISSAETVSSSSSSVSS<br>TIPSSQSTSYSTPSFSSSATSSVTPLHSTPSLPSVWTTSKTT<br>SHITPGLTSSMSSSETYSHSTPGFTSSITSTESTSESTPSLS<br>SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 435 | CID1947 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLDLIRKISNAQRMGCVLIGPSCTYSTFQMYLDTEL<br>SYPMISAGSFGLSCDYKETLTRLMSPARKLMYFLVNFWKTN<br>DLPFKTYSWSTSYVYKNGTETEDCFWYLNALEASVSYFSH<br>ELGFKWLRQDKEFQDILMDHNRKSNVIIMCGGPEFLYKLK<br>GDRAVAEDIVIILVDLFNDQYFEDNVTAPDYMKNVLVLTLSP<br>GNSLLNSSFSRNLSPTKRDFALAYLNGILLFGHMLKIFLENG<br>ENITTPKFAHAFRNLTFEGYDGPVTLDDWGDVDSTMVLLYT<br>SVDTKKYKVLLTYDTHVNKTYPVDMSPTFTWKNSKLPNDIT<br>GRGPQRTSDQASGAHHHHHGAYPYDVPDYAGHGTSGG<br>GGSGGTSTPSYTTSIISTETPSHSTPSSSTSITTTETPSHSTP<br>SYTSSVSTSETTSHSTPSETSSSRTTESTSYSSPSSTSSNTI<br>TETSSHSTPSTATSISSTETPSSSIPSVSSSITVTESSSHSTP<br>GATSTLTSSETSTWSTPSSTSSIMSSSYTSADTPSETSVYT<br>SSETPSSSSPTSTSLISSSKSTSTSPSFTSSITSTETSSYSA<br>SSYTPSVSSTASSSKNTTSSTASISSAETVSSSSSSVSSTIP<br>SSQSTSYSTPSFSSSATSSVTPLHSTPSLPSWVTTSKTTSHI |

TABLE 38-continued

| SEQ ID NO: | Description | Sequence |
|---|---|---|
| | | TPGLTSSMSSSETYSHSTPGFTSSITSTESTSESTPSLSSST<br>IYSTVSTSTTAITSHFTTSETAVTPTPVTPSSLSTDIPTTSLRT<br>LTPSSVGTSTSLTTTTDFPSIPTDISTLPTRTHIISSSPSIQST<br>ETSSLVGTTSPTMSTVRMTLRITENTPISSFSTSIWIPETPT<br>QTPPVLTSATGTQTSPAPTTVTFGSTDSSTSTLHKLQGDSG<br>ETIGKYIGAADSLGGSVLLLALAPLVLLSLL |
| 436 | CID1948 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLDLLKKISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSTPSFTSSITSTETSS<br>YSASSYTPSVSSTASSSKNTTSSTASISSAETVSSSSSSVSS<br>TIPSSQSTSYSTPSFSSSATSSVTPLHSTPSLPSWVTTSKTT<br>SHITPGLTSSMSSSETYSHSTPGFTSSITSTESTSESTPSLS<br>SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 437 | CID1949 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLDLLRQISNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSTPSFTSSITSTETSS<br>YSASSYTPSVSSTASSSKNTTSSTASISSAETVSSSSSSVSS<br>TIPSSQSTSYSTPSFSSSATSSVTPLHSTPSLPSWVTTSKTT<br>SHITPGLTSSMSSSETYSHSTPGFTSSITSTESTSESTPSLS<br>SSTIYSTVSTSTTAITSHFTTSETAVTPTPVTPSSLSTDIPTTS<br>LRTLTPSSVGTSTSLTTTTDFPSIPTDISTLPTRTHIISSSPSIQ<br>STETSSLVGTTSPTMSTVRMTLRITENTPISSFSTSIWIPET<br>PTQTPPVLTSATGTQTSPAPTTVTFGSTDSSTSTLHKLQGD<br>SGETIGKYIGAADSLGGSVLLLALAPLVLLSLL |
| 438 | CID1950 | MQLLRCFSIFSVIASVLAQEGKPIPNPLLGLDSTGGGSGGG<br>AQAAGAHSSQVSQNCHNGSYEISVLMMGNSAFAEPLKNLE<br>DAVNEGLEIVRGRLQNAGLNVTVNATFMYSDGLIHNSGDC<br>RSSTCEGLDLLRKIFNAQRMGCVLIGPSCTYSTFQMYLDTE<br>LSYPMISAGSFGLSCDYKETLTRLMSPARKLMYFLVNFWKT<br>NDLPFKTYSWSTSYVYKNGTETEDCFWYLNALEASVSYFS<br>HELGFKWLRQDKEFQDILMDHNRKSNVIIMCGGPEFLYKL<br>KGDRAVAEDIVIILVDLFNDQYFEDNVTAPDYMKNVLVLTLS<br>PGNSLLNSSFSRNLSPTKRDFALAYLNGILLFGHMLKIFLEN<br>GENITTPKFAHAFRNLTFEGYDGPVTLDDWGDVDSTMVLL<br>YTSVDTKKYKVLLTYDTHVNKTYPVDMSPTFTWKNSKLPN<br>DITGRGPQRTSDQASGAHHHHHHGAYPYDVPDYAGHGTS<br>GGGGSGGTSTPSYTTSIISTETPSHSTPSSSTSITTTETPSH<br>STPSYTSSVSTSETTSHSTPSETSSSRTTESTSYSSPSSTS<br>SNTITETSSHSTPSTATSISSTETPSSSIPSVSSSITVTESSSH<br>STPGATSTLTSSETSTWSTPSSTSSIMSSSYTSADTPSETS<br>VYTSSETPSSSSPTSTSLISSSKSTSTSTPSFTSSITSTETSS<br>YSASSYTPSVSSTASSSKNTTSSTASISSAETVSSSSSSVSS |

TABLE 38-continued

| SEQ ID NO: | Description | Sequence |
|---|---|---|
| | | TIPSSQSTSYSTPSFSSSATSSVTPLHSTPSLPSWVTTSKTT SHITPGLTSSMSSSETYSHSTPGFTSSITSTESTSESTPSLS SSTIYSTVSTSTTAITSHFTTSETAVTPTPVTPSSLSTDIPTTS LRTLTPSSVGTSTSLTTTTDFPSIPTDISTLPTRTHIISSSPSIQ STETSSLVGTTSPTMSTVRMTLRITENTPISSFSTSIWIPET PTQTPPVLTSATGTQTSPAPTTVTFGSTDSSTSTLHKLQGD SGETIGKYIGAADSLGGSVLLLALAPLVLLSLL |
| 439 | CID1431 | MQLLRCFSIFSVIASVLAQEGKPIPNPLLGLDSTGGGSGGG AQAAGAHSRTSDQASGAGAYPYDVPDYAGHGTSGGGGS GGTSTPSYTTSIISTETPSHSTPSSSTSITTTETPSHSTPSYT SSVSTSETTSHSTPSETSSSRTTESTSYSSPSSTSSNTITET SSHSTPSTATSISSTETPSSSIPSVSSSITVTESSSHSTPGAT STLTSSETSTWSTPSSTSSIMSSSYTSADTPSETSVYTSSET PSSSSPTSTSLISSSKSTSTSTPSFTSSITSTETSSYSASSYT PSVSSTASSSKNTTSSTASISSAETVSSSSSSVSSTIPSSQS TSYSTPSFSSSATSSVTPLHSTPSLPSWVTTSKTTSHITPGL TSSMSSSETYSHSTPGFTSSITSTESTSESTPSLSSSTIYST VSTSTTAITSHFTTSETAVTPTPVTPSSLSTDIPTTSLRTLTP SSVGTSTSLTTTTDFPSIPTDISTLPTRTHIISSSPSIQSTETS SLVGTTSPTMSTVRMTLRITENTPISSFSTSIWIPETPTQTP PVLTSATGTQTSPAPTTVTFGSTDSSTSTLHKLQGDSGETI GKYIGAADSLGGSVLLLALAPLVLLSLL |
| 440 | GUCY2C-0118_Light chain_Rabbit IgG version of clone 9H3 | DIVLTQSPASLAVSLGQRATISCRASESVDYYGTSLMQWYQ QKPGQPPKLLIYAASNVESGVPARFSGSGSGTDFSLNIHPV EEDDIAMYFCQQTRKVYTFGGGTKLEIKGDPVAPTVLIFPPA ADQVATGTVTIVCVANKYFPDVTVTWEVDGTTQTTGIENSK TPQNSADCTYNLSSTLTLTSTQYNSHKEYTCRVTQGTTSW QSFNRGDC |
| 441 | GUCY2C-0118_Heavy chain_Rabbit IgG version of clone 9H3 | QVQLQQPGAELVKPGASVKLSCKASGYTFTSYWMHWVKQ RPGQGLEWIGEIKPSNGLTNYIEKFKNKATLTVDKSATTAY MQLSSLTAEDSAVYYCTRTITTTEGYWFFDVWGAGTTVTV SSGQPKAPSVFPLAPCCGDTPSSTVTLGCLVKGYLPEPVTV TWNSGTLTNGVRTFPSVRQSSGLYSLSSWSVTSSSQPVT CNVAHPATNTKVDKTVAPSTCSKPTCPPPELLGGPSVFIFP PKPKDTLMISRTPEVTCVWDVSQDDPEVQFTWYINNEQV RTARPPLREQQFNSTIRWSTLPIAHQDWLRGKEFKCKVHN KALPAPIEKTISKARGQPLEPKVYTMGPPREELSSRSVSLTC MINGFYPSDISVEWEKNGKAEDNYKTTPAVLDSDGSYFLYS KLSVPTSEWQRGDVFTCSVMHEALHNHYTQKSISRSPGK |
| 442 | GUCY2C-0117_Light chain Mouse IgG1 of clone 9H3 | DIVLTQSPASLAVSLGQRATISCRASESVDYYGTSLMQWYQ QKPGQPPKLLIYAASNVESGVPARFSGSGSGTDFSLNIHPV EEDDIAMYFCQQTRKVYTFGGGTKLEIKRTDAAPTVSIFPPS SEQLTSGGASWCFLNNFYPKDINVKWKIDGSERQNGVLN SWTDQDSKDSTYSMSSTLTLTKDEYERHNSYTCEATHKTS TSPIVKSFNRNEC |
| 443 | GUCY2C-0117_Heavy chain Mouse IgG1 of clone 9H3 | QVQLQQPGAELVKPGASVKLSCKASGYTFTSYWMHWVKQ RPGQGLEWIGEIKPSNGLTNYIEKFKNKATLTVDKSATTAY MQLSSLTAEDSAVYYCTRTITTTEGYWFFDVWGAGTTVTV SSAKTTPPSVYPLAPGSAAQTNSMVTLGCLVKGYFPEPVTV TWNSGSLSSGVHTFPAVLQSDLYTLSSSVTVPSSTWPSET VTCNVAHPASSTKVDKKIVPRDCGCKPCICTVPEVSSVFIFP PKPKDVLTITLTPKVTCVWDISKDDPEVQFSWFVDDVEVH TAQTQPREEQFNSTFRSVSELPIMHQDWLNGKEFKCRVNS AAFPAPIEKTISKTKGRPKAPQVYTIPPPKEQMAKDKVSLTC MITDFFPEDITVEWQWNGQPAENYKNTQPIMDTDGSYFVY SKLNVQKSNWEAGNTFTCSVLHEGLHNHHTEKSLSHSPGK |
| 444 | GUCY2C-0119_Light chain_9H3 chimeric hu IgG1 3m in pTT5 | DIVLTQSPASLAVSLGQRATISCRASESVDYYGTSLMQWYQ QKPGQPPKLLIYAASNVESGVPARFSGSGSGTDFSLNIHPV EEDDIAMYFCQQTRKVYTFGGGTKLEIKRTVAAPSVFIFPPS DEQLKSGTASWCLLNNFYPREAKVQWKVDNALQSGNSQ ESVTEQDSKDSTYSLSSTLTLSKADYEKHKVYACEVTHQGL SSPVTKSFNRGEC |

TABLE 38-continued

| SEQ ID NO: | Description | Sequence |
|---|---|---|
| 445 | GUCY2C-0119_Heavy chain 9H3 chimeric hu IgG1 3m in pTT5 | QVQLQQPGAELVKPGASVKLSCKASGYTFTSYWMHWVKQ RPGQGLEWIGEIKPSNGLTNYIEKFKNKATLTVDKSATTAY MQLSSLTAEDSAVYYCTRTITTTEGYWFFDVWGAGTTVTV SSASTKGPSVFPLAPSSKSTSGGTAALGCLVKDYFPEPVTV SWNSGALTSGVHTFPAVLQSSGLYSLSSWTVPSSSLGTQ TYICNVNHKPSNTKVDKKVEPKSCDKTHTCPPCPAPEAAG APSVFLFPPKPKDTLMISRTPEVTCVVVDVSHEDPEVKFNW YVDGVEVHNAKTKPREEQYNSTYRWSVLTVLHQDWLNGK EYKCKVSNKALPAPIEKTISKAKGQPREPQVYTLPPSREEM TKNQVSLTCLVKGFYPSDIAVEWESNGQPENNYKTTPPVL DSDGSFFLYSKLTVDKSRWQQGNVFSCSVMHEALHNHYT QKSLSLSPG |

The antibody sequences of the present invention are numbered using the Abysis AbM. The Abysis AbM numbering system assigns Kabat numbering and determines the start and end of each CDR according to Kabat rules, except for CDR H1. The CDR H1 is determined according to the AbM definition.

Example 27

Three Anti-CD3 Variants Show Improved Affinity and Cytotoxicity in GUCY2C-CD3 Bispecific Antibodies Three anti-CD3 variants, 2B5-1038 (SEQ ID NOs: 273 and 274), 2B5-1039 (SEQ ID NOs: 273 and 275), and 265-1040 (SEQ ID NOs: 273 and 276) that are derived from 2B5v6, were reformatted into bispecific diabody-Fc molecules paired with anti-tumor GUCY2c antibody sequence in one of the configurations shown in FIG. 1 using standard cloning, expression and purification techniques described hereinabove. The resulting bispecific antibodies shown in Table 39 were tested for in vitro cytotoxicity using a T-cell retargeting assay and binding affinity using surface plasmon resonance (SPR) assay and non-specificity by AC-SINs. The immunogenicity risk was evaluated by Epivax Tool for in silico prediction of potential T-cell epitopes. Intact mass spectroscopy data indicates that all bispecifics have correct pairing and are 100% heterodimers. Table 39 demonstrates that all three bispecifics (1) are around 2-fold more potent in an in vitro cytotoxicity assay as compared to control bispecific GUCY2C-1608 which is paired with anti-CD3 2B5v6 (FIG. 18); (2) have binding affinity to recombinant human CD3 by SPR that is consistent with cytotoxicity activity; (3) have immunogenicity scores that are improved over control; and (4) AC-SINs scores maintained the same as control bispecific GUCY2C-1608.

TABLE 39

| Bispecific | CD3 variant | Epivax Score (tReg-Adjusted) | MassSpec (intact) | AC-SINs score | In vitro Cytotoxicity (nM) | KD (nM, SPR) |
|---|---|---|---|---|---|---|
| GUCY2C-1608 | 2B5-0542 | −33.7 | 100% heterodimer | 3 | 0.772 | 127.88 ± 1.63 |
| GUCY2C-1678 | 2B5-1038 | −52.61 | 100% heterodimer | 2 | 0.247 | 63.55 ± 0.49 |
| GUCY2C-1679 | 2B5-1040 | −47.58 | 100% heterodimer | 3 | 0.194 | 72.02 ± 0.36 |
| GUCY2C-1680 | 2B5-1039 | −53.51 | 100% heterodimer | 3 | 0.385 | 78.57 ± 0.9 |

Example 28

Affinity Maturation of Anti-GUCY2c Antibody Binding Domain

To increase affinity of the anti-GUCY2c antibody binding domain to GUCY2c a phage display approach was taken. Four phage display libraries were designed and produced using methods stated previously. Libraries were generated by introducing mutations into CDRs H1, H2 and H3 and CDR L1 of anti-GUCY2C-1608 (SEQ ID 221). Phage libraries were rescued as described previously and selected using a competitive selection strategy outlined in Table 40. For round 1, phage was incubated with streptavidin beads complexed with biotinylated human GUCY2c (5 nM; SEQ ID NO. 232). After 3 washes 100 times excess unbiotinylated antigen (500 nM) was added to the reaction and the mixture was rotated overnight at 4° C. Beads were washed the following day to remove phage that dissociated from the beads and remaining bound-phage was eluted using TEA. For round 2, the selection was repeated as above against 0.5 nM antigen without any competition. Colonies were picked and periplasmic preparations were generated as described previously. Clones were screened for improved binding activity using the competition ELISA previously described. Clones showing improved binding compared to the parental were selected for further analysis. Following screening, DNA sequencing was performed as described previously on the top clones to identify mutations that contributed to improved GUCY2c binding activity.

Following initial affinity maturation library selections, CDR regions from top hits were combined into a new library and additional phage display selections were performed outlined in Table 41. Round 1 selection was done as described above for the initial affinity library selection except 0.5 nM biotinylated antigen was used. For each library there were two round-2 selection branches in which phage prior to the selection was challenged or not challenged with 65° C. incubation. Following phage selections, colonies were picked and periplasmic preparations were generated as described previously. Clones were screened by competition ELISA described previously. Following screening, DNA sequencing was performed on the top clones to identify mutations that contributed to improved GUCY2c binding activity. Tables 40 and 41 show the phage display selection strategy used for the affinity maturation libraries (C=library; R=round; Dslxn=deselection condition; Therm=thermal condition; SA=streptavidin; D=DNA; I=insulin; M=membrane extract).

TABLE 40

| Round | Condition | |
|---|---|---|
| R1 | Branch | C1R1 |
| | Target | Human GUCY2C |
| | Target Conc. | 5 nM |
| | Dslxn | SA, D, I, M |
| | Therm | None |
| | Competition | 500 nM |
| R2 | Branch | C1R2 |
| | Target | Human GUCY2C |
| | Target Conc. | 5 nM |

TABLE 40-continued

| Round | Condition | |
|---|---|---|
| | Dslxn | SA, D, I, M |
| | Therm | None |
| | Competition | None |

TABLE 41

| Round | Condition | |
|---|---|---|
| R1 | Branch | C1R1 |
| | Target | Human GUCY2C |
| | Target Conc. | 0.5 nM |
| | Dslxn | SA, D, I, M |
| | Therm | None |
| | Competition | 500 nM |
| R2A | Branch | C1R2A |
| | Target | Human GUCY2C |
| | Target Conc. | 0.5 nM |
| | Dslxn | SA, D, I, M |
| | Therm | None |
| | Competition | 500 nM |
| R2B | Branch | C1R2B |
| | Target | Human GUCY2C |
| | Target Conc. | 0.5 nM |
| | Dslxn | SA, D, I, M |
| | Therm | 65° C. |
| | Competition | 500 nM |

The amino acid sequences for the GUCY2c antibody clones showing improved affinity by periprep competition ELISA were compared against the parental clone GUCY2C-1608 (VH SEQ ID NO: 73 and VL SEQ ID NO: 147). Changes to amino acid content in VH CDRs leading to improved stability are shown in Table 42A. Changes in positions 54, 55, 56, 97, and 99 appeared to have the greatest impact on affinity, correlating with the largest changes in time resolved fluorescence (according to the so numbering system of Kabat, using the AbM definition for VH CDR1).

TABLE 42A

| Designation | | Position | Parent Amino Acid | Optimized Amino Acid |
|---|---|---|---|---|
| VH CDR1 (H1) | H1.31 | 31 | S | R, W, Y, A, H, P, Y, T, N, K, D, G, V |
| | H1.32 | 32 | Y | R, L, T, K, P, I, N, M, V, S |
| VH CDR2 (H2) | H2.52A | 52A | P | T, V |
| | H2.53 | 53 | S | A, L, R |
| | H2.54 | 54 | N | T, R, H, K, M, S, A, Y, T, I |
| | H2.55 | 55 | E | R, K, N, Y, G, L, A, M, S, H, D, Q |
| | H2.56 | 56 | L | W, Y, F, V, I, N, H |
| | H2.57 | 57 | T | M, S, L, N, Q, V |
| VH FW3 | | 93 | T | A |
| VH CDR3 (H3) | H3.96 | 96 | I | F, K |
| | H3.97 | 97 | T | V, L, I, M, F, Y, A |
| | H3.98 | 98 | T | N, R, G, L, I |
| | H3.99 | 99 | T | K, L, W, A, S, M, P, N, R |
| | H3.100 | 100 | E | G, A, H, S, D, T, R, Q, K, Y, L, M |

TABLE 42A-continued

| Designation | Position | Parent Amino Acid | Optimized Amino Acid |
|---|---|---|---|
| H3.100B | 100B | Y | H |
| H3.100E | 100E | F | L |
| H3.101 | 101 | D | Y, E, S |

Changes to amino acid content in VL CDRs leading to improved affinity by periprep competition ELISA are shown in Table 42B (the numbering system of Chothia was used for VL CDR1. Changes in positions 30, 30a, and 30d in VL CDR1 appeared to have the greatest impact on affinity, correlating with the largest changes in time resolved fluorescence.

TABLE 42B

| | Designation | Position | Parent Amino Acid | Optimized Amino Acid |
|---|---|---|---|---|
| VL CDR1 (L1) | L1.30 | 30 | D | N, S |
| | L1.30a | 30a | Y | W, I |
| | L1.30d | 30d | T | S, H |

Following screening in scFv format as periplasmic preparations, VH and VL sequences from top clones were cloned into the full human IgG1/kappa format. VH and VL genes were PCR amplified out of the phage vector and sub-cloned into the human IgGI and human kappa vectors using molecular biology techniques previously described. The human IgG1 version of these top affinity matured clones were then transiently expressed and purified using methods also previously described. Purified proteins were then analyzed by surface plasmon resonance as before against human GUCY2c recombinant protein (SEQ ID NO. 232). Table 43 shows the on-rate (ka), off-rate (kd), and equilibrium constant ($K_D$) for the affinity matured clones comparing to the parental GUCY2C-1608 in IgG form (GUCy2c-1640, SEQ ID NOs. 214 and 223). Several variants show improved affinity by as much as 3.4-fold compared to the parent antibody. Table 44 shows the full VH and VL amino acid sequences for these affinity-matured versions of GUCY2C-1608.

TABLE 43

Surface plasmon resonance of affinity matured anti-GUCY2c IgG against human GUCY2c extracellular domain protein (ECD).

| Ligand | ka (1/Ms) | kd (1/s) | $K_D$ (nM) |
|---|---|---|---|
| GUCY2C-1640 | 1.95E+05 | 2.71E-03 | 13.87 ± 0.38 |
| GUCY2C-1696 | 1.44E+05 | 1.79E-03 | 12.42 ± 0.55 |
| GUCY2C-1701 | 2.35E+05 | 2.79E-03 | 11.85 ± 0.38 |
| GUCY2C-1702 | 2.46E+05 | 1.51E-03 | 6.16 ± 0.34 |
| GUCY2C-1703 | 2.10E+05 | 2.14E-03 | 10.32 ± 1.34 |
| GUCY2C-1705 | 2.39E+05 | 1.49E-03 | 6.25 ± 0.04 |
| GUCY2C-1706 | 1.98E+05 | 1.93E-03 | 9.75 ± 0.07 |
| GUCY2C-1708 | 1.40E+05 | 1.32E-03 | 9.44 ± 0.4 |
| GUCY2C-1710 | 2.48E+05 | 1.47E-03 | 5.94 ± 0.24 |
| GUCY2C-1713 | 1.61E+05 | 1.08E-03 | 6.71 ± 0.33 |
| GUCY2C-1714 | 1.21E+05 | 1.24E-03 | 10.27 ± 0.59 |
| GUCY2C-1715 | 2.72E+05 | 1.10E-03 | 4.07 ± 0.4 |

TABLE 44

Amino acid sequences of affinity-matured VH and VL regions

| | | |
|---|---|---|
| SEQ ID NO. 294 | GUCY2C-1696_VH | EVQLVESGGGLVQPGGSLRLSCAASGFTFSTRWMHWVR QAPGKGLEWIGEIKPSNKLTNVHEKFKDRFTISVDKAKNS AYLQMNSLRAEDTAVYYCARTITTTEGYWFLSDWGQGTL VTVSS |
| SEQ ID NO. 295 | GUCY2C-1696_VL | DIQLTQSPSSLSASVGDRVTITCRASESVDYYGHSLMQW YQQKPGKAPKLLIYAASKLASGVPSRFSGSGSGTDFTLTI SSLQPEDFATYYCQQTRKAYTFGQGTKLEIK |
| SEQ ID NO. 296 | GUCY2C-1701_VH | EVQLVESGGGLVQPGGSLRLSCAASGFTFSSYWMHWVR QAPGKGLEWIGEIKPSNELTNVHEKFKDRFTISVDKAKNS AYLQMNSLRAEDTAVYYCTRTITTPLGYWFFDVWGQGTL VTVSS |
| SEQ ID NO. 297 | GUCY2C-1701_VL | DIQLTQSPSSLSASVGDRVTITCRASESVDYYGSSLMQW YQQKPGKAPKLLIYAASKLASGVPSRFSGSGSGTDFTLTI SSLQPEDFATYYCQQTRKAYTFGQGTKLEIK |
| SEQ ID NO. 298 | GUCY2C-1702_VH | EVQLVESGGGLVQPGGSLRLSCAASGFTFSSYWMHWVR QAPGKGLEWIGEIKPSNELTNVHEKFKDRFTISVDKAKNS AYLQMNSLRAEDTAVYYCTRTITTPLGYWFFDVWGQGTL VTVSS |
| SEQ ID NO. 299 | GUCY2C-1702_VL | DIQLTQSPSSLSASVGDRVTITCRASESVDYYGSSLMQW YQQKPGKAPKLLIYAASKLASGVPSRFSGSGSGTDFTLTI SSLQPEDFATYYCQQTRKAYTFGQGTKLEIK |
| SEQ ID NO. 300 | GUCY2C-1703_VH | EVQLVESGGGLVQPGGSLRLSCAASGFTFSSYWMHWVR QAPGKGLEWIGEIKPSNRWNNVHEKFKDRFTISVDKAKN SAYLQMNSLRAEDTAVYYCTRTITTTEGYWFFDVWGQGT LVTVSS |
| SEQ ID NO. 301 | GUCY2C-1703_VL | DIQLTQSPSSLSASVGDRVTITCRASESVDYYGSSLMQW YQQKPGKAPKLLIYAASKLASGVPSRFSGSGSGTDFTLTI SSLQPEDFATYYCQQTRKAYTFGQGTKLEIK |

TABLE 44-continued

Amino acid sequences of affinity-matured_VH and_VL regions

| SEQ ID NO. 302 | GUCY2C-1705_VH | EVQLVESGGGLVQPGGSLRLSCAASGFTFSSYWMHWVRQAPGKGLEWIGEIKPSRGFTNVHEKFKDRFTISVDKAKNSAYLQMNSLRAEDTAVYYCTRTITTTEGYWFFDVWGQGTLVTVSS |
| SEQ ID NO. 303 | GUCY2C-1705_VL | DIQLTQSPSSLSASVGDRVTITCRASESVDYYGSSLMQWYQQKPGKAPKLLIYAASKLASGVPSRFSGSGSGTDFTLTISSLQPEDFATYYCQQTRKAYTFGQGTKLEIK |
| SEQ ID NO. 304 | GUCY2C-1706_VH | EVQLVESGGGLVQPGGSLRLSCAASGFTFSSTWMHWVRQAPGKGLEWIGEIKPSNELTNVHEKFKDRFTISVDKAKNSAYLQMNSLRAEDTAVYYCTRTITTTEGYWFFDVWGQGTLVTVSS |
| SEQ ID NO. 305 | GUCY2C-1706_VL | DIQLTQSPSSLSASVGDRVTITCRASESVDYYGSSLMQWYQQKPGKAPKLLIYAASKLASGVPSRFSGSGSGTDFTLTISSLQPEDFATYYCQQTRKAYTFGQGTKLEIK |
| SEQ ID NO. 306 | GUCY2C-1708_VH | EVQLVESGGGLVQPGGSLRLSCAASGFTFSRPWMHWVRQAPGKGLEWIGEIKPSTGWTNVHEKFKDRFTISVDKAKNSAYLQMNSLRAEDTAVYYCTRTITTTTGYWFFDVWGQGTLVTVSS |
| SEQ ID NO. 307 | GUCY2C-1708_VL | DIQLTQSPSSLSASVGDRVTITCRASESVDYYKHSLMQWYQQKPGKAPKLLIYAASKLASGVPSRFSGSGSGTDFTLTISSLQPEDFATYYCQQTRKAYTFGQGTKLEIK |
| SEQ ID NO. 308 | GUCY2C-1710_VH | EVQLVESGGGLVQPGGSLRLSCAASGFTFSSYWMHWVRQAPGKGLEWIGEIKPSRGWTNVHEKFKDRFTISVDKAKNSAYLQMNSLRAEDTAVYYCARTITTTEGYWFFDVWGQGTLVTVSS |
| SEQ ID NO. 309 | GUCY2C-1710_VL | DIQLTQSPSSLSASVGDRVTITCRASESVDYYRHSLMQWYQQKPGKAPKLLIYAASKLASGVPSRFSGSGSGTDFTLTISSLQPEDFATYYCQQTRKAYTFGQGTKLEIK |
| SEQ ID NO. 310 | GUCY2C-1713_VH | EVQLVESGGGLVQPGGSLRLSCAASGFTFSHTWMHWVRQAPGKGLEWIGEIKPSRGFTNVHEKFKDRFTISVDKAKNSAYLQMNSLRAEDTAVYYCTRTITTTQGYWFFDVWGQGTLVTVSS |
| SEQ ID NO. 311 | GUCY2C-1713_VL | DIQLTQSPSSLSASVGDRVTITCRASESVNWYGSSLMQWYQQKPGKAPKLLIYAASKLASGVPSRFSGSGSGTDFTLTISSLQPEDFATYYCQQTRKAYTFGQGTKLEIK |
| SEQ ID NO. 312 | GUCY2C-1714_VH | EVQLVESGGGLVQPGGSLRLSCAASGFTFSHTWMHWVRQAPGKGLEWIGEIKPSTKYTNVHEKFKDRFTISVDKAKNSAYLQMNSLRAEDTAVYYCARTIFTREGYWFFDVWGQGTLVTVSS |
| SEQ ID NO. 313 | GUCY2C-1714_VL | DIQLTQSPSSLSASVGDRVTITCRASESVNWYGSSLMQWYQQKPGKAPKLLIYAASKLASGVPSRFSGSGSGTDFTLTISSLQPEDFATYYCQQTRKAYTFGQGTKLEIK |
| SEQ ID NO. 314 | GUCY2C-1715_VH | EVQLVESGGGLVQPGGSLRLSCAASGFTFSSYWMHWVRQAPGKGLEWIGEIKPSTKYTNVHEKFKDRFTISVDKAKNSAYLQMNSLRAEDTAVYYCTRTIFTNEGYWFFDVWGQGTLVTVSS |
| SEQ ID NO. 315 | GUCY2C-1715_VL | DIQLTQSPSSLSASVGDRVTITCRASESVSIYGSSLMQWYQQKPGKAPKLLIYAASKLASGVPSRFSGSGSGTDFTLTISSLQPEDFATYYCQQTRKAYTFGQGTKLEIK |

Example 29

Epitope Determination by Peptide Mapping of GUCY2C Extracellular Domain

Peptide mapping was performed to determine the epitope on the GUCY2c extracellular domain (ECD) where the lead GUCY2c antibody binds. For this approach, 20-mer peptides, with 15 aa overlap were generated, covering the entire extracellular domain into the transmembrane domain of GUCY2c consisting of amino acids 1-440 (Table 45). Peptides were synthesized and provided as arrays in lyophilized format (New England Peptide, Gardner Mass.). Arrays were reconstituted with acetonitrile to 100 µg/ml and were then further diluted to 20 µg/ml with sodium carbonate/bicarbonate buffer. Purified antibodies or GUCY2c-CD3 bispecifics were then tested by Delfia ELISA for binding to the different peptides using Delfia ELISA methods previously discussed, with diluted peptides used as the target antigen. GUCY2C-1608 showed strong binding to peptides 19 and 20 (SEQ ID NOs: 334 and 335) as measured by time resolved fluorescence (TRF). TRF Binding data for GUCY2C-1608 against all peptides is shown in Table 45. The sequence, NSGDCRSSTCEGLDLLRKISNAQRM (SEQ ID NO: 405) is spanned by these peptides. A region of overlap among the peptides is RSSTCEGLDLLRKIS (SEQ ID NO: 406) indicating an epitope within the region.

TABLE 45

| Seq ID | Peptide No. | Peptide Sequence | DELFIA TRF |
|---|---|---|---|
| 316 | 1 | MKTLLLDLALWSLLFQPGWL | 166.25 |
| 317 | 2 | LDLALWSLLFQPGWLSFSSQ | 106.5 |
| 318 | 3 | WSLLFQPGWLSFSSQVSQNC | 97.75 |
| 319 | 4 | QPGWLSFSSQVSQNCHNGSY | 124.75 |
| 320 | 5 | SFSSQVSQNCHNGSYEISVL | 108.75 |
| 321 | 6 | VSQNCHNGSYEISVLMMGNS | 412.5 |
| 322 | 7 | HNGSYEISVLMMGNSAFAEP | 136 |
| 323 | 8 | EISVLMMGNSAFAEPLKNLE | 147.5 |
| 324 | 9 | MMGNSAFAEPLKNLEDAVNE | 145 |
| 325 | 10 | AFAEPLKNLEDAVNEGLEIV | 105.25 |
| 326 | 11 | LKNLEDAVNEGLEIVRGRLQ | 101.25 |
| 327 | 12 | DAVNEGLEIVRGRLQNAGLN | 258.75 |
| 328 | 13 | GLEIVRGRLQNAGLNVTVNA | 101.5 |
| 329 | 14 | RGRLQNAGLNVTVNATFMYS | 97 |
| 330 | 15 | NAGLNVTVNATFMYSDGLIH | 88.75 |
| 331 | 16 | VTVNATFMYSDGLIHNSGDC | 105.25 |
| 332 | 17 | TFMYSDGLIHNSGDCRSSTC | 112 |
| 333 | 18 | DGLIHNSGDCRSSTCEGLDL | 126 |
| 334 | 19 | NSGDCRSSTCEGLDLLRKIS | 19179.25 |
| 335 | 20 | RSSTCEGLDLLRKISNAQRM | 3208.75 |
| 336 | 21 | EGLDLLRKISNAQRMGCVLI | 81 |
| 337 | 22 | LRKISNAQRMGCVLIGPSCT | 93.5 |
| 338 | 23 | NAQRMGCVLIGPSCTYSTFQ | 96.25 |
| 339 | 24 | GCVLIGPSCTYSTFQMYLDT | 118.75 |
| 340 | 25 | GPSCTYSTFQMYLDTELSYP | 131 |
| 341 | 26 | YSTFQMYLDTELSYPMISAG | 104.25 |
| 342 | 27 | MYLDTELSYPMISAGSFGLS | 105 |
| 343 | 28 | ELSYPMISAGSFGLSCDYKE | 96.75 |
| 344 | 29 | MISAGSFGLSCDYKETLTRL | 101 |
| 345 | 30 | SFGLSCDYKETLTRLMSPAR | 125 |
| 346 | 31 | CDYKETLTRLMSPARKLMYF | 90.25 |
| 347 | 32 | TLTRLMSPARKLMYFLVNFW | 83.25 |
| 348 | 33 | MSPARKLMYFLVNFWKTNDL | 87.5 |
| 349 | 34 | KLMYFLVNFWKTNDLPFKTY | 99 |
| 350 | 35 | LVNFWKTNDLPFKTYSWSTS | 108 |

TABLE 45-continued

| Seq ID | Peptide No. | Peptide Sequence | DELFIA TRF |
|---|---|---|---|
| 351 | 36 | KTNDLPFKTYSWSTSYVYKN | 111.5 |
| 352 | 37 | PFKTYSWSTSYVYKNGTETE | 106.75 |
| 353 | 38 | SWSTSYVYKNGTETEDCFWY | 109.5 |
| 354 | 39 | YVYKNGTETEDCFWYLNALE | 86.5 |
| 355 | 40 | GTETEDCFWYLNALEASVSY | 85.25 |
| 356 | 41 | DCFWYLNALEASVSYFSHEL | 161 |
| 357 | 42 | LNALEASVSYFSHELGFKVV | 96.5 |
| 358 | 43 | ASVSYFSHELGFKVVLRQDK | 104 |
| 359 | 44 | FSHELGFKVVLRQDKEFQDI | 90.5 |
| 360 | 45 | GFKVVLRQDKEFQDILMDHN | 107.5 |
| 361 | 46 | LRQDKEFQDILMDHNRKSNV | 105.75 |
| 362 | 47 | EFQDILMDHNRKSNVIIMCG | 103.75 |
| 363 | 48 | LMDHNRKSNVIIMCGGPEFL | 148 |
| 364 | 49 | RKSNVIIMCGGPEFLYKLKG | 129.25 |
| 365 | 50 | IIMCGGPEFLYKLKGDRAVA | 161 |
| 366 | 51 | GPEFLYKLKGDRAVAEDIVI | 96.75 |
| 367 | 52 | YKLKGDRAVAEDIVIILVDL | 103.75 |
| 368 | 53 | DRAVAEDIVIILVDLFNDQY | 87.75 |
| 369 | 54 | EDIVIILVDLFNDQYLEDNV | 112.25 |
| 370 | 55 | ILVDLFNDQYLEDNVTAPDY | 100.25 |
| 371 | 56 | FNDQYLEDNVTAPDYMKNVL | 81 |
| 372 | 57 | LEDNVTAPDYMKNVLVLTLS | 99.75 |
| 373 | 58 | TAPDYMKNVLVLTLSPGNSL | 98.5 |
| 374 | 59 | MKNVLVLTLSPGNSLLNSSF | 135.25 |
| 375 | 60 | MKNVLVLTLSPGNSLLNSSF | 150.25 |
| 376 | 61 | VLTLSPGNSLLNSSFSRNLS | 125.5 |
| 377 | 62 | PGNSLLNSSFSRNLSPTKRD | 91.25 |
| 378 | 63 | LNSSFSRNLSPTKRDFALAY | 109.5 |
| 379 | 64 | SRNLSPTKRDFALAYLNGIL | 116 |
| 380 | 65 | PTKRDFALAYLNGILLFGHM | 103 |
| 381 | 66 | FALAYLNGILLFGHMLKIFL | 114.25 |
| 382 | 67 | LNGILLFGHMLKIFLENGEN | 93.25 |
| 383 | 68 | LFGHMLKIFLENGENITTPK | 73.5 |
| 384 | 69 | LKIFLENGENITTPKFAHAF | 100.5 |
| 385 | 70 | ENGENITTPKFAHAFRNLTF | 91.75 |
| 386 | 71 | ITTPKFAHAFRNLTFEGYDG | 105 |
| 387 | 72 | FAHAFRNLTFEGYDGPVTLD | 116 |
| 388 | 73 | RNLTFEGYDGPVTLDDWGDV | 116.25 |
| 389 | 74 | EGYDGPVTLDDWGDVDSTMV | 100 |

TABLE 45-continued

| Seq ID | Peptide No. | Peptide Sequence | DELFIA TRF |
|---|---|---|---|
| 390 | 75 | PVTLDDWGDVDSTMVLLYTS | 88.25 |
| 391 | 76 | DWGDVDSTMVLLYTSVDTKK | 102 |
| 392 | 77 | DSTMVLLYTSVDTKKYKVLL | 98.25 |
| 393 | 78 | LLYTSVDTKKYKVLLTYDTH | 97.75 |
| 394 | 79 | VDTKKYKVLLTYDTHVNKTY | 130 |
| 395 | 80 | YKVLLTYDTHVNKTYPVDMS | 1468.75 |
| 396 | 81 | TYDTHVNKTYPVDMSPTFTW | 109 |
| 397 | 82 | VNKTYPVDMSPTFTWKNSKL | 99.25 |
| 398 | 83 | PVDMSPTFTWKNSKLPNDIT | 85.75 |
| 399 | 84 | PTFTWKNSKLPNDITGRGPQ | 133 |
| 400 | 85 | KNSKLPNDITGRGPQILMIA | 163.25 |
| 401 | 86 | PNDITGRGPQILMIAVFTLT | 110.5 |
| 402 | 87 | LRKISNAQRMGCVLIGPSCT | 102 |
| 403 | 88 | NAQRMGCVLIGPSCTYSTFQ | 120.25 |
| 404 | 89 | GCVLIGPSCTYSTFQMYLDT | 115 |
| 405 |  | NSGDCRSSTCEGLDLLRKISNAQRM |  |
| 406 |  | RSSTCEGLDLLRKIS |  |

GUCY2c peptide 19 (SEQ ID NO: 334) was then competed with the full extracellular domain in a competition DELFIA ELISA using methods previously described and was shown to effectively compete with the full extracellular domain (FIG. 19). This suggests that peptide 19 (SEQ ID NO 334) contains the specific epitope where GUCY2C-1608 binds on the full GUCY2c extracellular domain.

GUCY2C-1608 Binds Different GUCY2c ECD Epitope Than Antibody MS20

GUCY2C-1608 binding to GUCY2c extracellular domain was also compared to known anti-GUCY2c antibodies. Antibody MS20 disclosed in US2013/315923 did not have a reported epitope. To compare this antibody to GUCY2C-1608, a competition Delfia ELISA was performed using a modified method of the Delfia competition ELISA previously described. Here, human GUCY2c protein (SEQ ID NO. 232) was coated on the plate as before. GUCY2C-1640 (IgG version of GUCY2C-1608; SEQ ID NOs. 214 and 223) or MS20 antibody were serially diluted starting at 20 μg/ml then combined with a rabbit chimeric IgG version of GUCY2C-0098 (SEQ ID NOs. 440 and 441, which consists of SEQ ID NOs: 26 and 106 fused to rabbit constant domain) at 250 ng/ml (EC50 value determined separately). Plates were washed as before and a secondary anti-rabbit europium antibody (Perkin Elmer) diluted 1:1000 was added for detection. TRF signal was detected as before. A decrease in TRF signal indicates competitive binding as the rabbit chimeric version of GUCY2C-0098 is displaced from binding to human GUCY2c. As expected, GUCY2C-1640 displaces the rabbit chimeric version of GUCY2C-0098 while MS20 does not (FIG. 20). Accordingly, GUCY2C-1608 binds to a different GUCY2c ECD epitope than MS20 Antibody.

Example 30

GUCY2c-1608 Binds Different GUCY2c ECD Epitope Than Antibody 5F9

Antibodies described in US2011/0110936 were reported to bind to different epitope sequences on GUCY2c ECD from peptide 19 (SEQ ID NO 334) as described hereinbelow.

3×10e6 cells expressing human, rat and chicken GUCY2c (CID1814, 1815 and 1818, respectively), point mutants CID1941-1950, "patch" mutants CID1868-1873 (patch mutants consist of 2-5 human GUCY2c amino acid residues replaced by amino acid residues from the equivalent positions in chicken GUCY2c) or human-chicken GUCY2c chimeras CID1874-1881 (>5 human GUCY2c amino acids substituted by chicken GUCY2c residues) or confirmatory reverse chimeras CID1939 & 1940 (>5 chicken GUCY2c amino acids substituted by human GUCY2c residues) or negative control CID1431 (negative control construct containing no GUCY2s sequence but with same epitope tags as other constructs expressed on yeast surface), were added per well in a 96-well plate. The cells were incubated with anti-V5 (Abcam 27671) antibody, monovalent or divalent anti-GUCY2c antibodies, antibody GUCY2C-1608 or antibody 5F9 antibody (Millennium antibody described in US2011/0110936) for 1 hour at room temperature. Cells were then washed three times with PBS+0.5% BSA buffer. Cells were then incubated with PE-conjugated anti-mouse IgG or PE-conjugated anti-human IgG or PE-conjugated anti-HA antibody (Miltenyi Biotec 130-092-257) for 30 minutes at 4° C. in a dark place. Cells were washed three times with PBS+0.5% BSA buffer and then analyzed on a flow cytometer.

MFI (median fluorescence intensity) of anti-GUCY2c antibody binding to the cells was normalized to expression on cell surface measured by MFI of anti-tag antibodies. All the cells expressed V5 and HA on the cell surface for expression normalization. Table 46 shows normalized relative binding of anti-GUCY2c antibodies to each GUCY2c construct. Chimeras (except CID1939 and CID1940), point mutants and patch mutants that do not bind to the anti-GUCY2c Ab indicate that GUCY2c residues changed in those constructs are important for binding to the antibody. Restoration of binding of GUCY2C-1608 and not antibody 5F9 to reverse chimeras CID1939 and CID1940 confirms that antibody GUCY2C-1608 binds residues 68 to 87 on GUCY2c (SEQ ID NO: 224) and shows that the binding site of antibody 5F9 does not overlap with that of antibody GUCY2C-1608.

TABLE 46

| GUCY2c construct (SEQ ID) | Ab GUCY2Cc-1608 | Ab 5F9 |
|---|---|---|
| CID1814 (410) | + | + |
| CID1815 (411) | + | − |
| CID1818 (412) | − | − |
| CID1868 (413) | − | + |

TABLE 46-continued

| GUCY2c construct (SEQ ID) | Ab GUCY2Cc-1608 | Ab 5F9 |
|---|---|---|
| CID1869 (414) | + | + |
| CID1870 (415) | + | + |
| CID1871 (416) | + | + |
| CID1872 (417) | + | + |
| CID1873 (418) | + | + |
| CID1874 (419) | − | + |
| CID1875 (420) | + | + |
| CID1876 (421) | + | + |
| CID1877 (422) | + | + |
| CID1878 (423) | + | + |
| CID1879 (424) | + | + |
| CID1880 (425) | + | + |
| CID1881 (426) | + | + |
| CID1939 (427) | + | − |
| CID1940 (428) | + | − |
| CID1941 (429) | + | + |
| CID1942 (430) | + | + |
| CID1943 (431) | + | + |
| CID1944 (432) | + | + |
| CID1945 (433) | − | + |
| CID1946 (434) | + | + |
| CID1947 (435) | + | + |
| CID1948 (436) | + | + |
| CID1949 (437) | + | + |
| CID1950 (438) | + | + |
| CID1431 (439) | − | − |

Example 31

Crystallization and Structure Determination of Anti-GUCY2C-1608 scFv Plus GUCY2c-Peptide Complex For crystallization trials, the complex between GUCY2C-1608 scFv (SEQ ID NO 409) and GUCY2c-ECD peptide number 19 $^{68}$NSGDCRSSTCEGLDLLRKIS$^{87}$ (SEQ ID NO 334) was formed at 1:1.2 molar ratio and was concentrated to 8.8 mg/ml in a protein solution containing TBS at pH 7.5. The crystals were obtained by hanging-drop vapor-diffusion method from a condition containing 20% PEG 3350, 200 mM Lithium Sulfate, bis-tris pH 5.5. The rod-like crystals had symmetry consistent with monoclinic space group=P2$_1$2$_1$2$_1$ with cell parameters a=70.68 Å; b=80.57 Å; c=90.7 Å and with two copies of GUCY2C-1608 scFv-peptide complexes in the crystallographic asymmetric unit. The crystals were cryo-protected using reservoir solution containing 20% ethylene glycol and were flash frozen in liquid nitrogen. A data set to a 1.6 Å resolution was collected from a single frozen crystal at IMCA beamline 17-ID at the Argonne National Laboratory (APS). The data were processed and scaled using autoPROC, and the final data set was 71.4% complete.

The structure was solved by molecular replacement with PHASER starting with the single chain Fv fragment obtained from the structure of anti-GUCY2c CD3 bispecific (FIG. 22). The solution was obtained by searching for the two copies of GUCY2C-1608 scFv. The resulting electron density maps calculated with the two copies of GUCY2C-1608 scFv as a model unambiguously showed extra electron densities for the two peptides, each bound to the corresponding copy of GUCY2C-1608 scFv.

Several iterative rounds of manual adjustment and model rebuilding using COOT and crystallographic refinement using autoBUSTER yielded the final model of GUCY2C-1608 scFv+peptide with a crystallographic R$_{work}$ of 19.7% and R$_{free}$ of 21.7%, where R$_{work}$=∥F$_{obs}$∣−∣F$_{calc}$∥/∣F$_{obs}$∣ and R$_{free}$ is equivalent to R$_{work}$, but calculated for a randomly chosen 5% of reflections omitted from the refinement process.

A. Description of GUCY2C-1608 scFv-Peptide Structure

The 17-residue long GUCY2c-peptide adopts mostly an α-helical confirmation upon binding to the CDR-regions of GUCY2C-1608 scFv (FIG. 21). The α-helix is disulfide SS-bond-constrained to the N-terminus of the peptide. The total binding interface area buried under interaction is ~1,320 Å$^2$ which is surprisingly large for an only 17 amino acid residue long fragment. The binding interface is predominantly hydrophobic with some specific polar contacts at its center and hydrogen-bonding contacts at its periphery (FIG. 21).

The binding epitope contacts that are within 3.8 Å with GUCY2C-1608 scFv are defined by underlined residues in the peptide sequence: $^{68}$NSGDCRSSTCEGLDLLRKIS$^{87}$ and are listed in Table 47. The amino acids contributing >75% of its surface area to the binding interface are highlighted in bold. The binding paratope of GUCY2C-1608 scFv is defined by 5 CDR-regions: CDR-H1, CDR-H2, CDR-H3, CDR-L1 and CDR-L3. Amino acids of GUCY2C-1608 scFv (paratope) and GUCY2c-peptide (epitope) that are involved in contact within 3.8 Å are listed in Table 48.

TABLE 47

| GUCY2c epitope residues | | | | |
|---|---|---|---|---|
| Type | Chain GUCY2c | Position | % BSA | Electrostatic Interactions |
| ARG | C | 73 | 50.28431 | H |
| SER | C | 74 | 56.99118 | |
| SER | C | 75 | 93.22802 | H |
| THR | C | 76 | 85.61988 | H |
| GLU | C | 78 | 46.89699 | H |
| GLY | C | 79 | 86.96493 | W |
| LEU | C | 80 | 78.57378 | |
| LEU | C | 82 | 28.2139 | |
| LEU | C | 83 | 88.59774 | |
| ARG | C | 84 | 40.15275 | |
| ILE | C | 86 | 23.20466 | |

TABLE 48

Amino acids that define Paratope (chains H + L) and Epitope (chain C)
Residues having atoms within 3.80 Angstrom

| Antigen Chain | Antigen Residue | Antibody Chain | Antibody Residue (Sequential) | (Kabat) |
|---|---|---|---|---|
| C | 73 | H | 33 | 33 |
| C | 73 | H | 57 | 56 |
| C | 73 | H | 58 | 57 |
| C | 73 | H | 59 | 58 |
| C | 74 | H | 33 | 33 |
| C | 74 | H | 50 | 50 |
| C | 74 | H | 59 | 58 |
| C | 75 | H | 33 | 33 |
| C | 75 | H | 50 | 50 |
| C | 75 | L | 99 | 96 |
| C | 76 | L | 96 | 92 |
| C | 76 | L | 98 | 94 |
| C | 78 | H | 33 | 33 |
| C | 79 | H | 107 | 100C |
| C | 80 | H | 107 | 100C |
| C | 80 | L | 31 | 27D |
| C | 80 | L | 96 | 92 |
| C | 82 | H | 101 | 97 |
| C | 83 | H | 104 | 100 |
| C | 83 | H | 105 | 100A |
| C | 83 | L | 36 | 32 |
| C | 84 | L | 31 | 27D |
| C | 84 | L | 32 | 28 |
| C | 86 | H | 103 | 99 |
| C | 86 | H | 104 | 100 |
| C | 86 | H | 105 | 100A |

B. Crystallization and Structure Determination of anti-GUCY2c CD3 Bispecific

For crystallization trials, a modified version of GUCY2C-1608 was generated with either a His6 tag or a FLAG tag at the C-terminus of each VL-VH subunit chain to aid in purification. The GUCY2c CD3 bispecific antibody for crystallography was generated using the sequences GUCY2C-1637 VH (SEQ ID NO. 407) and GUCY2C-1637 VL (SEQ ID NO. 408). The constructs were transiently transfected into FreeStyle™ 293 HEK cells as described above. Following harvest of the conditioned media, 2.5 mL of Ni-NTA resin pre-equilibrated in TBS was allowed to batch-bind to the protein for 1 hour at 4° C. on an orbital mixer. The resin was then collected and placed in an Applied Biosystems column (Life Technologies, Grand Island, N.Y., USA). Resin was first washed to baseline with Buffer A (50 mM sodium phosphate, 300 mM sodium chloride pH 8.0), then with five CVs of Buffer A supplemented with 20 mM imidazole and finally eluted with Buffer A+250 mM imidazole. Fractions with the highest purity were pooled and dialyzed into PBS using a 30 ml cassette with a 10 kD MWCO over 2 hours at 4° C. The dialyzed protein was then further purified by anti-FLAG chromatography. Forty mL anti-FLAG M2 resin (Sigma, St. Louis, Mo., USA) was pre-equilibrated in TBS and allowed to batch-bind in 1.4 L conditioned medium overnight at 4° C. The resin was then collected and packed into a column for anti-FLAG M2 chromatography, washed to baseline with TBS (20 CVs) and initially eluted with 0.1 M FLAG peptide buffer and finally eluted with 0.1 M glycine pH 3.0. The eluted protein was immediately neutralized with 10% 1.0 M Tris pH 8.0. Fractions with the highest purity were then pooled and further purified by size exclusion chromatography using a Superdex200 column (GE Healthcare, Piscataway, N.J., USA) and stored in TBS.

For crystallization trials, the purified His/FLAG version of GUCY2C-1608 was concentrated to 12 mg/ml in a protein solution containing TBS pH 7.5. The crystals were obtained by hanging-drop vapor-diffusion method from a condition containing 1M Sodium Malonate pH 6, 2% ethylene imine polymer. The crystals had symmetry consistent with hexagonal space group=P3$_2$2$_1$ with cell parameters a=b=119.55 Å and c=121.85 Å and with one copy of the diabody in the crystallographic asymmetric unit. The crystals were cryo-protected using reservoir solution containing 2.8M Sodium Malonate pH 6 and were flash frozen in liquid nitrogen. A data set to a 2.03 Å resolution was collected from a single frozen crystal at IMCA beamline 17-ID at the Argonne National Laboratory (APS). The data were processed and scaled using autoPROC, and the final data set was 49.3% complete.

The structure was solved by molecular replacement with PHASER starting with the single chain Fv fragment models prepared from the Brookhaven PDB entry 1 moe. The solution was obtained by searching for each of the four subunits of the diabody molecule separately. Several iterative rounds of manual adjustment and model rebuilding using COOT and crystallographic refinement using auto-BUSTER yielded the final model of the diabody with a crystallographic $R_{work}$ of 19.1% and $R_{free}$ of 20.8%, where $R_{work}=\|F_{obs}|-|F_{calc}\|/|F_{obs}|$ and $R_{free}$ is equivalent to $R_{work}$, but calculated for a randomly chosen 5% of reflections omitted from the refinement process.

C. Description of Anti-GUCY2C-CD3 Diabody Structure

The two antigen binding sites on the GUCY2c CD3 bispecific antibody are separated by about 70 Å and are located on the opposite sides of the molecule, directly across from each other (FIG. 22). Both the anti-CD3 CDR and anti-GUCY2c CDR regions are positioned remotely from the subunit interface.

Example 32

In Vivo Evaluation of GUCY2c CD3 Bispecific Combination with Anti-VEGF-A mAb and Axitinib Human PBMCs were thawed into media (X-VIVO 15 (Lonza), 5% human serum albumin (Gemini #100-318), 1% Penn/Strep, 0.01 mM 2-mercaptoethanol) at approximately 5 million cells per ml. Cells were spun down and resuspended in Robosep buffer (Stem Cell Technologies) at a concentration of 50 million cells per ml. T cells were isolated using the EasySep human T cell enrichment kit (Stem cell technologies. T cells were activated and expanded using a Human T cell activation/Expansion kit (Miltenyi). On day 2, T cells were transferred to a G-Rex cell culture device for expansion, and IL-2 (Stem Cell Technologies) was added to the media and replenished after 2 days. T cells were harvested 1 week after activation/expansion. At the time of harvest, beads were removed with a magnet, and cells were resuspended in DPBS at 1×10$^7$ cells/mL for in vivo inoculation.

NSG mice were inoculated with colorectal patient derived xenograft PDX-CRX-11201 fragments subcutaneously in the flank. Tumor measurements were collected using a digital Vernier caliper, and volumes were calculated by use of the modified ellipsoid formula ½×length×width2. Mice were randomized and staged at tumor size of 150-200 mm$^3$. An initial dose of GUCY2c bispecific (GUCY2C-1608), negative control bispecific, or vehicle was administered to animals on day 0, and 2 million cultured T-cells were inoculated the following day. Mice were dosed in 0.2 mL bolus injection weekly up to 3 times, and all compound and T-cell administrations were intravenous via the tail vein of each animal. Combination agents were administered starting on Day 0. Anti-VEGF mAb (G6-31) was administered every 3 days up to 4 times intravenously via the tail vein. Axitinib was administered twice daily up to 14 days via oral gavage. Tumor measurements were collected twice weekly along with continuous monitoring for signs of a graft versus host response.

GUCY2c CD3 bispecific administered at 0.05 mg/kg had a partial anti-tumor response in the PDX-11201 adoptive transfer model. Anti-VEGF mAb and axitinib also had a partial anti-tumor response in this model when administered alone at 5 mg/kg and 15 mg/kg respectively. The combination of GUCY2c CD3 bispecific with either Anti-VEGF mAb or with axitinib resulted in additive anti-tumor responses showing complete tumor inhibition.

GUCY2C-1608 shows enhanced tumor growth inhibition in combination with an anti-VEGF mAb as well as axitinib in PDX-CRX-11201 colorectal carcinoma patient derived xenograft model with adoptive T cell transfer.

Example 33

In Vivo Evaluation of GUCY2c CD3 Bispecific Combination with Anti-PD1

Human PBMCs were thawed into media (X-VIVO 15 (Lonza). 5% human serum albumin (Gemini #100-318), 1% Penn/Strep, 0.01 mM 2-mercaptoethanol) at approximately 5 million cells per ml. Cells were spun down and resuspended in Robosep buffer (Stem Cell Technologies) at a concentration of 50 million cells per ml. T cells were isolated using the EasySep human T cell enrichment kit (Stem cell technologies. T cells were activated and expanded using a Human T cell activation/Expansion kit (Miltenyi). On day 2, T cells were transferred to a G-Rex cell culture device for expansion, and IL-2 (Stem Cell Technologies) was added to the media and replenished after 2 days. T cells were harvested 1 week after activation/expansion. At the time of harvest, beads were removed with a magnet, and cells were resuspended in DPBS at $1\times10^7$ cells/mL for in vivo inoculation.

NSG mice were inoculated with colorectal cancer cell line LS1034 cells subcutaneously in the flank. Tumor measurements were collected using a digital Vernier caliper, and volumes were calculated by use of the modified ellipsoid formula ½×length×width2. Mice were randomized and staged at tumor size of 150-200 mm³. An initial dose of GUCY2c bispecific (GUCY2C-1608) at 0.03 mg/kg, negative control bispecific at 0.1 mg/kg, Anti-PD1 (pembrolizumab biosimilar D265A hIgG1a Fc effector function mutant) at 5 mg/kg, or vehicle was administered to animals on day 0, and 2 million cultured T-cells were inoculated the following day. Mice were dosed in 0.2 mL bolus injection weekly up to 3 times, and all compound and T-cell administrations were intravenous via the lateral tail vein of each animal. Tumor measurements were collected twice weekly along with continuous monitoring for signs of a graft versus host response.

GUCY2c CD3 bispecific administered at 0.03 mg/kg had a partial anti-tumor response in the LS1034 adoptive transfer model. Anti-PD-1 had no anti-tumor response in this model when administered at 10 mg/kg. The combination of GUCY2c CD3 bispecific with anti-PD-1 resulted in an additive anti-tumor response (FIG. 24).

GUCY2C-1608 shows enhanced tumor growth inhibition in combination with an anti-PD1 mAb in LS1034 colorectal carcinoma cell line derived xenograft model with adoptive T cell transfer.

Example 34

In Vivo Evaluation of GUCY2c CD3 Bispecific Combination with Anti-PDL1

Human PBMCs were thawed into media (X-VIVO 15 (Lonza). 5% human serum albumin (Gemini #100-318), 1% Penn/Strep, 0.01 mM 2-mercaptoethanol) at approximately 5 million cells per ml. Cells were spun down and resuspended in Robosep buffer (Stem Cell Technologies) at a concentration of 50 million cells per ml. T cells were isolated using the EasySep human T cell enrichment kit (Stem cell technologies. T cells were activated and expanded using a Human T cell activation/Expansion kit (Miltenyi). On day 2, T cells were transferred to a G-Rex cell culture device for expansion, and IL-2 (Stem Cell Technologies) was added to the media and replenished after 2 days. T cells were harvested 1 week after activation/expansion. At the time of harvest, beads were removed with a magnet, and cells were resuspended in DPBS at $1\times10^7$ cells/mL for in vivo inoculation.

NSG mice were inoculated with colorectal cancer cell line LS1034 cells subcutaneously in the flank. Tumor measurements were collected using a digital Vernier caliper, and volumes were calculated by use of the modified ellipsoid formula ½×length×width2. Mice were randomized and staged at tumor size of 150-200 mm³. An initial dose of GUCY2c bispecific (GUCY2C-1608) at 0.03 mg/kg or negative control bispecific at 0.1 mg/kg, or vehicle was administered to animals on day 0, and 2 million cultured T-cells were inoculated the following day. Mice were dosed in 0.2 mL bolus injection weekly up to 3 times, and all compound and T-cell administrations were intravenous via the lateral tail vein of each animal. Anti-PDL1 was administered intravenously starting at day 0 every 3 days up to 6 times. Tumor measurements were collected twice weekly along with continuous monitoring for signs of a graft versus host response.

GUCY2c CD3 bispecific administered at 0.03 mg/kg had a partial anti-tumor response in the LS1034 adoptive transfer model. Anti-PD-L1 had no anti-tumor response in this model when administered at 10 mg/kg. The combination of GUCY2c CD3 bispecific with anti-PD-L1 resulted in an additive anti-tumor response (FIG. 25).

GUCY2C-1608 shows enhanced tumor growth inhibition in combination with an anti-PD-L1 mAb in LS1034 colorectal carcinoma cell line derived xenograft model with adoptive T cell transfer.

Example 35

A Phase 1 Dose Escalation and Expansion Study Evaluating the Safety, Tolerability, Pharmacokinetics, Pharmacodynamics and Anti-Tumor Activity of GUCY2c-1608 Bispecific Antibody in Patients with Advanced Gastrointestinal Tumors This Example sets forth a Phase 1, open-label, multicenter, multiple-dose, safety, PK and PD study of GUCY2c-1608 bispecific antibody. The study contains two parts, dose escalation as a single agent and dose finding in combination (either anti-PD-1 or anti-VEGF) (Parts 1A and 1B, respectively) followed by dose expansion (Part 2). Sequential cohorts of patients with advanced/metastatic gastrointestinal tumors, including colorectal, gastric and esophageal adenocarcinomas, that are not candidates for regimens known to provide clinical benefit, will receive escalating doses of GUCY2c-1608 bispecific antibody, in Part 1A of the study. In Part 1B, dose finding evaluation of GUCY2c-1608 bispecific antibody in combination (either anti-PD-1 or anti-VEGF), will occur in patients with advanced/metastatic colorectal, gastric and esophageal adenocarcinomas. Part 2 (dose expansion phase) will evaluate the Recommended Phase 2 Dose (RP2D) selected from Part 1 (dose escalation phase) either as a monotherapy or in combination (either anti-PD-1 or anti-VEGF) in patients with previously treated colorectal adenocarcinomas. Biomarker cohorts requiring paired tumor biopsies in these patients may occur in Parts 1A and 1B as the Maximum Tolerated Dose (MTD) is approached or at the RP2D/MTD and in subsets of the dose expansion arms in Part 2.

Escalating doses of GUCY2c-1608 will be administered as a weekly subcutaneous (SC) injection in 21-day cycles. The proposed starting SC dose is 0.6 µg/kg.

Upon determining the GUCY2c-1608 RP2D/MTD as monotherapy, Part 1B dose cohorts will be initiated to explore safety, tolerability, and preliminary anti-tumor activity of this dose level in combination (either anti-PD-1 or anti-VEGF). The dose expansion phase (Part 2) will evaluate the RP2D of GUCY2c-1608 as monotherapy and with a combination agent (either anti-PD-1 or anti-VEGF) in patients with advanced/metastatic colorectal adenocarcinomas.

There will also be a minimum 72-hour interval between the first dose administered to each of the initial patients (i.e., patients contributing to initial Dose Limiting Toxicity (DLT) evaluation) enrolled at a new dose level. All patients will be observed in-patient for at least 48 hours or longer after the first SC dose on Cycle 1 Day 1 (C1D1) for Part 1.

Treatment with GUCY2c-1608 will continue until either disease progression, patient refusal, or unacceptable toxicity occurs, whichever is earliest, unless the investigator and medical monitor agree to treatment beyond disease progression based on individual benefit/risk assessments.

Alternative Dosing Regimen with IV Dose Administration

Based on the available emerging clinical data (including safety/tolerability, PK, PD, and other) from the dose escalation cohorts with SC administration, intravenous (IV) administration may be evaluated.

The evaluation of a priming dose to allow subsequent higher level dose administration may be instituted in this study.

Criteria for Dose Escalation

For administration cohorts, initial dose levels are provided in Table 49; intermediate doses may be evaluated based on clinical findings. For SC administration cohorts, during the initial dose escalation levels, maximum dose increases will be up to 250% but will be adjusted to no more than 100% following the observation of a DLT.

TABLE 49

| SC Dose Escalation Levels for Administration | |
|---|---|
| Dose Level | Dose (µg/kg) |
| DL1 (Starting Dose) | 0.6 |

TABLE 49-continued

| SC Dose Escalation Levels for Administration | |
|---|---|
| Dose Level | Dose (µg/kg) |
| DL 2 | 2.0 |
| DL 3 and higher | Escalation to continue to MTD or desired pharmacologic activity |

*Intermediate doses may be evaluated based on clinical findings

Dose escalation will stop when stopping criteria are met as determined by one of skill in the art.

Part 1A of the study aims to determine a MTD for a SC dose regimen, however if dosing regimen is switched to IV, then MTD will be determined for IV dose administration. If introduction of dose prime is required for IV then MTD will be determined for IV with priming dose regimen.

Part 1B will aim to determine the MTD of GUCY2c-1608 with a combination agent (either anti-PD-1 or anti-VEGF).

The RP2D is the dose chosen for further study based on Phase 1 study results.

Patient Selection

For dose escalation (Part 1A and 1B): Histological or cytological diagnosis of advanced/metastatic colorectal, gastric, or esophageal adenocarcinoma that is resistant to standard therapy or for which no standard therapy is available.

For dose expansion (Part 2): Histological or cytological diagnosis of previously treated colorectal adenocarcinoma with at least one measurable lesion, not previously irradiated, as defined by RECIST version 1.1, that is resistant to standard therapy or for which no standard therapy is available.

Cytokine Release Syndrome Management

Cytokine release syndrome (CRS) management and a revised CRS grading system is adapted from D. W. Lee, et al: Current Concepts in the Diagnosis and Management of Cytokine Release Syndrome. Blood 124 (2014) 188-195.

Anti-IL6 administration: Consider 4 mg/kg over 1 hour and administering a second dose if no clinical improvement within 24 to 48 hours.

The disclosure of every patent, patent application, and publication cited herein is hereby incorporated herein by reference in its entirety.

EQUIVALENT

While this invention has been disclosed with reference to specific embodiments, it is apparent that other embodiments and variations of this invention can be devised by others skilled in the art without departing from the true spirit and scope of the invention. The subject matter of the invention includes all those other embodiments and variations, including combinations and subcombinations of the various elements, features, functions, and/or properties disclosed herein. The following claims particularly point out certain combinations and subcombinations regarded as novel and nonobvious. Invention embodied in other combinations and subcombinations of features, functions, elements, and/or properties may be claimed in this application, in applications claiming priority from this application, or in related applications. Such claims, whether directed to a different invention or to the same invention, and whether broader, narrower, equal, or different in scope in comparison to the original claims, also are regarded as included within the subject matter of the inventions of the present disclosure.

SEQUENCE LISTING (445 sequences)

SEQ ID NO: 1 - protein, 121 aa, Artificial Sequence
  Synthetic peptide sequence
EVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSS

SEQ ID NO: 2 - protein, 10 aa, Artificial Sequence
  Synthetic peptide sequence
GFTFSDYYMT

SEQ ID NO: 3 - protein, 19 aa, Artificial Sequence
  Synthetic peptide sequence
FIRNRARGYTSDHNPSVKG

SEQ ID NO: 4 - protein, 10 aa, Artificial Sequence
  Synthetic peptide sequence
DRPSYYVLDY

SEQ ID NO: 5 - protein, 25 aa, Artificial Sequence [sequence omitted]

SEQ ID NO: 6 - protein, 14 aa, Artificial Sequence
  Synthetic peptide sequence
WVRQAPGKGLEWVA

SEQ ID NO: 7 - protein, 32 aa, Artificial Sequence
  Synthetic peptide sequence
RFTISRDNAKNSLYLQMNSLRAEDTAVYYCAR

SEQ ID NO: 8 - protein, 11 aa, Artificial Sequence
  Synthetic peptide sequence
WGQGTTVTVSS

SEQ ID NO: 9 - protein, 121 aa, Artificial Sequence
  Synthetic peptide sequence
EVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSS

SEQ ID NO: 10 - protein, 19 aa, Artificial Sequence
  Synthetic peptide sequence
FIRNQARGYTSDHNPSVKG

SEQ ID NO: 11 - protein, 114 aa, Artificial Sequence
  Synthetic peptide sequence
EVQLQQSGAELARPGASVNLSCKASGYTFTTYWMQWVKQRPGQGLEWIGAIYPGDGMTTYTQKFKDKATLTADKSSSTAYMQLSSLASEDSAVYYCVRKGMDYWGQGTSVTVSS

SEQ ID NO: 12 - protein, 10 aa, Artificial Sequence
  Synthetic peptide sequence
GYTFTTYWMQ

SEQ ID NO: 13 - protein, 17 aa, Artificial Sequence
  Synthetic peptide sequence
AIYPGDGMTTYTQKFKD

SEQ ID NO: 14 - protein, 5 aa, Artificial Sequence
  Synthetic peptide sequence
KGMDY

SEQ ID NO: 15 - protein, 25 aa, Artificial Sequence
  Synthetic peptide sequence
EVQLQQSGAELARPGASVNLSCKAS

SEQ ID NO: 16 - protein, 14 aa, Artificial Sequence
  Synthetic peptide sequence
WVKQRPGQGLEWIG

SEQ ID NO: 17 - protein, 32 aa, Artificial Sequence
  Synthetic peptide sequence
KATLTADKSSSTAYMQLSSLASEDSAVYYCVR

SEQ ID NO: 18 - protein, 11 aa, Artificial Sequence
  Synthetic peptide sequence
WGQGTSVTVSS

SEQ ID NO: 19 - protein, 120 aa, Artificial Sequence
  Synthetic peptide sequence
EVQLQQSGAELARPGASVKLSCKASGYTFTKYWMQWIKQRPGQGLEWIGAIYPGDGFTTYTQKFKGKATLTADKSSNTAYMQLSSLASEDSAVYYCARRNYGRTYGGDYWGQGTSVTVSS

SEQ ID NO: 20 - protein, 10 aa, Artificial Sequence
  Synthetic peptide sequence
GYTFTKYWMQ

SEQ ID NO: 21 - protein, 17 aa, Artificial Sequence
  Synthetic peptide sequence
AIYPGDGFTTYTQKFKG

SEQ ID NO: 22 - protein, 11 aa, Artificial Sequence
  Synthetic peptide sequence
RNYGRTYGGDY

SEQ ID NO: 23 - protein, 25 aa, Artificial Sequence
  Synthetic peptide sequence
EVQLQQSGAELARPGASVKLSCKAS

SEQ ID NO: 24 - protein, 14 aa, Artificial Sequence
  Synthetic peptide sequence
WIKQRPGQGLEWIG

SEQ ID NO: 25 - protein, 32 aa, Artificial Sequence
  Synthetic peptide sequence
KATLTADKSSNTAYMQLSSLASEDSAVYYCAR

SEQ ID NO: 26 - protein, 122 aa, Artificial Sequence
  Synthetic peptide sequence
QVQLQQPGAELVKPGASVKLSCKASGYTFTSYWMHWVKQRPGQGLEWIGEIKPSNGLTNYIEKFKNKATLTVDKSATTAYMQLSSLTAEDSAVYYCTRTITTTEGYWFFDVWGAGTTVTVSS

SEQ ID NO: 27 - protein, 10 aa, Artificial Sequence
  Synthetic peptide sequence
GYTFTSYWMH

SEQ ID NO: 28 - protein, 17 aa, Artificial Sequence
  Synthetic peptide sequence
EIKPSNGLTNYIEKFKN

SEQ ID NO: 29 - protein, 13 aa, Artificial Sequence
  Synthetic peptide sequence
TITTTEGYWFFDV

SEQ ID NO: 30 - protein, 25 aa, Artificial Sequence
  Synthetic peptide sequence
QVQLQQPGAELVKPGASVKLSCKAS

SEQ ID NO: 31 - protein, 32 aa, Artificial Sequence
  Synthetic peptide sequence
KATLTVDKSATTAYMQLSSLTAEDSAVYYCTR

SEQ ID NO: 32 - protein, 11 aa, Artificial Sequence
  Synthetic peptide sequence
WGAGTTVTVSS

SEQ ID NO: 33 - protein, 115 aa, Artificial Sequence
  Synthetic peptide sequence
EVQLQQSGAELVKPGASVKLSCTASGFNIKDTYIHWVKQRPEQGLEWIGRIDPANGNANYDPKFQGKATITADTSSNTAYLQLSSLTSEDTAVFYCSSLGTGTYWGQGTTLTVSS

SEQ ID NO: 34 - protein, 10 aa, Artificial Sequence
  Synthetic peptide sequence
GFNIKDTYIH

SEQ ID NO: 35 - protein, 17 aa, Artificial Sequence
  Synthetic peptide sequence
RIDPANGNANYDPKFQG

SEQ ID NO: 36 - protein, 6 aa, Artificial Sequence
  Synthetic peptide sequence
LGTGTY

SEQ ID NO: 37 - protein, 25 aa, Artificial Sequence
  Synthetic peptide sequence
EVQLQQSGAELVKPGASVKLSCTAS

SEQ ID NO: 38 - protein, 14 aa, Artificial Sequence
  Synthetic peptide sequence
WVKQRPEQGLEWIG

SEQ ID NO: 39 - protein, 32 aa, Artificial Sequence
  Synthetic peptide sequence
KATITADTSSNTAYLQLSSLTSEDTAVFYCSS

SEQ ID NO: 40 - protein, 11 aa, Artificial Sequence
  Synthetic peptide sequence
WGQGTTLTVSS

SEQ ID NO: 41 - protein, 123 aa, Artificial Sequence
  Synthetic peptide sequence
EVQLQQSGPELVKPGASVKISCKASGYSFTDYIMLWVKQSHGKSLEWIGNSNPYYGSTSYNLKFKGKATLTVDKSSSTAYMHLNSLTSEDSAVYYCARSGYYGSSPYWYFDVWGAGTTVTVSS

SEQ ID NO: 42 - protein, 10 aa, Artificial Sequence
  Synthetic peptide sequence
GYSFTDYIML

SEQ ID NO: 43 - protein, 17 aa, Artificial Sequence
  Synthetic peptide sequence
NSNPYYGSTSYNLKFKG

SEQ ID NO: 44 - protein, 14 aa, Artificial Sequence
  Synthetic peptide sequence
SGYYGSSPYWYFDV

SEQ ID NO: 45 - protein, 25 aa, Artificial Sequence
  Synthetic peptide sequence
EVQLQQSGPELVKPGASVKISCKAS

SEQ ID NO: 46 - protein, 14 aa, Artificial Sequence
  Synthetic peptide sequence
WVKQSHGKSLEWIG

SEQ ID NO: 47 - protein, 32 aa, Artificial Sequence
  Synthetic peptide sequence
KATLTVDKSSSTAYMHLNSLTSEDSAVYYCAR

SEQ ID NO: 48 - protein, 114 aa, Artificial Sequence
  Synthetic peptide sequence
EVQLVESGGGLVQPGGSLRLSCAASGYTFTTYWMQWVRQAPGKGLEWIGAIYPGDGMTTYTQKFKDRFTISADKAKNSAYLQMNSLRAEDTAVYYCVRKGMDYWGQGTLVTVSS

SEQ ID NO: 49 - protein, 14 aa, Artificial Sequence
  Synthetic peptide sequence
WVRQAPGKGLEWIG

SEQ ID NO: 50 - protein, 32 aa, Artificial Sequence
  Synthetic peptide sequence
RFTISADKAKNSAYLQMNSLRAEDTAVYYCVR

SEQ ID NO: 51 - protein, 11 aa, Artificial Sequence
  Synthetic peptide sequence
WGQGTLVTVSS

SEQ ID NO: 52 - protein, 114 aa, Artificial Sequence
  Synthetic peptide sequence
QVQLVQSGAEVKKPGASVKVSCKASGYTFTTYWMQWVRQAPGQGLEWIGAIYPGDGMTTYTQKFQGRVTMTRDTSTSTVYMELSSLRSEDTAVYYCVRKGMDYWGQGTLVTVSS

SEQ ID NO: 53 - protein, 17 aa, Artificial Sequence
  Synthetic peptide sequence
AIYPGDGMTTYTQKFQG

SEQ ID NO: 54 - protein, 25 aa, Artificial Sequence [sequence omitted]

SEQ ID NO: 55 - protein, 14 aa, Artificial Sequence
  Synthetic peptide sequence
WVRQAPGQGLEWIG

SEQ ID NO: 56 - protein, 32 aa, Artificial Sequence
  Synthetic peptide sequence
RVTMTRDTSTSTVYMELSSLRSEDTAVYYCVR

SEQ ID NO: 57 - protein, 123 aa, Artificial Sequence
  Synthetic peptide sequence
EVQLVESGGGLVQPGGSLRLSCAASGYSFTDYIMLWVRQAPGKGLEWIGNSNPYYGSTSYNLKFKGRFTISVDKAKNSAYLQMNSLRAEDTAVYYCARSGYYGSSPYWYFDVWGQGTMVTVSS

SEQ ID NO: 58 - protein, 32 aa, Artificial Sequence
  Synthetic peptide sequence
RFTISVDKAKNSAYLQMNSLRAEDTAVYYCAR

SEQ ID NO: 59 - protein, 11 aa, Artificial Sequence
  Synthetic peptide sequence
WGQGTMVTVSS

SEQ ID NO: 60 - protein, 122 aa, Artificial Sequence
  Synthetic peptide sequence
EVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSS

SEQ ID NO: 61 - protein, 32 aa, Artificial Sequence
  Synthetic peptide sequence
RFTISVDKAKNSAYLQMNSLRAEDTAVYYCTR

SEQ ID NO: 62 - protein, 122 aa, Artificial Sequence
  Synthetic peptide sequence
EVQLVESGGGLVQPGGSLRLSCAASGYTFTSYWMHWVRQAPGKGLEWIAEIKPSNGLTNYIEKFKNRFTISRDNAKNSLYLQMNSLRAEDTAVYYCARTITTTEGYWFFDVWGQGTLVTVSS

SEQ ID NO: 63 - protein, 14 aa, Artificial Sequence
  Synthetic peptide sequence
WVRQAPGKGLEWIA

SEQ ID NO: 64 - protein, 122 aa, Artificial Sequence
  Synthetic peptide sequence
EVQLVESGGGLVQPGGSLRLSCAASGYTFTSYWMHWVRQAPGKGLEWIGEIKPSNGLTNYIEKFKNRFTISRDNAKNSLYLQMNSLRAEDTAVYYCARTITTTEGYWFFDVWGQGTLVTVSS

SEQ ID NO: 65 - protein, 122 aa, Artificial Sequence
  Synthetic peptide sequence
EVQLVESGGGLVQPGGSLRLSCAASGYTFTSYWMHWVRQAPGKGLEWIGEIKPSNGLTNIHPKFKNRFTISVDKAKNSAYLQMNSLRAEDTAVYYCTRTITTTEGYWFFDVWGQGTLVTVSS

SEQ ID NO: 66 - protein, 17 aa, Artificial Sequence
  Synthetic peptide sequence
EIKPSNGLTNIHPKFKN

SEQ ID NO: 67 - protein, 122 aa, Artificial Sequence
  Synthetic peptide sequence
EVQLVESGGGLVQPGGSLRLSCAASGYTFTSYWMHWVRQAPGKGLEWIGEIKPSNGLTNYNEKFKNRFTISVDKAKNSAYLQMNSLRAEDTAVYYCTRTITTTEGYWFFDVWGQGTLVTVSS

SEQ ID NO: 68 - protein, 17 aa, Artificial Sequence
  Synthetic peptide sequence
EIKPSNGLTNYNEKFKN

SEQ ID NO: 69 - protein, 122 aa, Artificial Sequence
  Synthetic peptide sequence
EVQLVESGGGLVQPGGSLRLSCAASGYTFTSYWMHWVRQAPGKGLEWIGEIKPSNGLTNVHEKFKNRFTISVDKAKNSAYLQMNSLRAEDTAVYYCTRTITTTEGYWFFDVWGQGTLVTVSS

SEQ ID NO: 70 - protein, 17 aa, Artificial Sequence
  Synthetic peptide sequence
EIKPSNGLTNVHEKFKN

SEQ ID NO: 71 - protein, 122 aa, Artificial Sequence
  Synthetic peptide sequence
EVQLVESGGGLVQPGGSLRLSCAASGYTFTSYWMHWVRQAPGKGLEWIGEIKPSNGLTNYAEQFKNRFTISVDKAKNSAYLQMNSLRAEDTAVYYCTRTITTTEGYWFFDVWGQGTLVTVSS

SEQ ID NO: 72 - protein, 17 aa, Artificial Sequence
  Synthetic peptide sequence
EIKPSNGLTNYAEQFKN

SEQ ID NO: 73 - protein, 122 aa, Artificial Sequence
  Synthetic peptide sequence
EVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSS

SEQ ID NO: 74 - protein, 10 aa, Artificial Sequence
  Synthetic peptide sequence
GFTFSSYWMH

SEQ ID NO: 75 - protein, 17 aa, Artificial Sequence
  Synthetic peptide sequence
EIKPSNELTNVHEKFKD

SEQ ID NO: 76 - protein, 112 aa, Artificial Sequence
  Synthetic peptide sequence
DIQMTQSPSSLSASVGDRVTITCTSSQSLFNVRSRKNYLAWYQQKPGKAPKLLIYWASTRESGVPSRFSGSGSGTDFTLTISSLQPEDFATYYCKQSYDLFTFGGGTKVEIK

SEQ ID NO: 77 - protein, 17 aa, Artificial Sequence
  Synthetic peptide sequence
TSSQSLFNVRSRKNYLA

SEQ ID NO: 78 - protein, 7 aa, Artificial Sequence
  Synthetic peptide sequence
WASTRES

SEQ ID NO: 79 - protein, 8 aa, Artificial Sequence
  Synthetic peptide sequence
KQSYDLFT

SEQ ID NO: 80 - protein, 23 aa, Artificial Sequence
  Synthetic peptide sequence
DIQMTQSPSSLSASVGDRVTITC

SEQ ID NO: 81 - protein, 15 aa, Artificial Sequence
  Synthetic peptide sequence
WYQQKPGKAPKLLIY

SEQ ID NO: 82 - protein, 32 aa, Artificial Sequence
  Synthetic peptide sequence
GVPSRFSGSGSGTDFTLTISSLQPEDFATYYC

SEQ ID NO: 83 - protein, 10 aa, Artificial Sequence
  Synthetic peptide sequence
FGGGTKVEIK

SEQ ID NO: 84 - protein, 112 aa, Artificial Sequence
  Synthetic peptide sequence
DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIK

SEQ ID NO: 85 - protein, 17 aa, Artificial Sequence
  Synthetic peptide sequence
KSSQSLFNVRSRKNYLA

SEQ ID NO: 86 - protein, 23 aa, Artificial Sequence
  Synthetic peptide sequence
DIVMTQSPDSLAVSLGERATINC

SEQ ID NO: 87 - protein, 15 aa, Artificial Sequence
  Synthetic peptide sequence
WYQQKPGQPPKLLIS

SEQ ID NO: 88 - protein, 32 aa, Artificial Sequence
  Synthetic peptide sequence
GVPDRFSGSGSGTDFTLTISSLQAEDVAVYYC

SEQ ID NO: 89 - protein, 10 aa, Artificial Sequence
  Synthetic peptide sequence
FGSGTKLEIK

SEQ ID NO: 90 - protein, 112 aa, Artificial Sequence
  Synthetic peptide sequence
DIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIK

SEQ ID NO: 91 - protein, 17 aa, Artificial Sequence
  Synthetic peptide sequence
TSSQSLFNVRSQKNYLA

SEQ ID NO: 92 - protein, 111 aa, Artificial Sequence
  Synthetic peptide sequence
DIVLTQSPASLAVSLGQRATISCRASESVDNYGISFMNWFQQKPGQPPKLLIYAASNPGSGVPARFSGSGSGTDFSLNIHPLEEDDTAMFFCQQSKEVPYTFGGGTKLEIK

SEQ ID NO: 93 - protein, 15 aa, Artificial Sequence
  Synthetic peptide sequence
RASESVDNYGISFMN

SEQ ID NO: 94 - protein, 7 aa, Artificial Sequence
  Synthetic peptide sequence
AASNPGS

SEQ ID NO: 95 - protein, 9 aa, Artificial Sequence
  Synthetic peptide sequence
QQSKEVPYT

SEQ ID NO: 96 - protein, 23 aa, Artificial Sequence
  Synthetic peptide sequence
DIVLTQSPASLAVSLGQRATISC

SEQ ID NO: 97 - protein, 15 aa, Artificial Sequence
  Synthetic peptide sequence
WFQQKPGQPPKLLIY

SEQ ID NO: 98 - protein, 32 aa, Artificial Sequence
  Synthetic peptide sequence
GVPARFSGSGSGTDFSLNIHPLEEDDTAMFFC

SEQ ID NO: 99 - protein, 10 aa, Artificial Sequence
  Synthetic peptide sequence
FGGGTKLEIK

SEQ ID NO: 100 - protein, 111 aa, Artificial Sequence
  Synthetic peptide sequence
DIVLTQSPASLAVSLGQRATISCRASESVDNFDISFMNWFQQKPGQPPKLLIYAASNQGSGVPARFSGSGSGTDFSLNIHPMEEDDTAMYFCQQSKEVPYTFGGGTKLEIK

SEQ ID NO: 101 - protein, 15 aa, Artificial Sequence
  Synthetic peptide sequence
RASESVDNFDISFMN

SEQ ID NO: 102 - protein, 7 aa, Artificial Sequence
  Synthetic peptide sequence
AASNQGS

SEQ ID NO: 103 - protein, 32 aa, Artificial Sequence
  Synthetic peptide sequence
GVPARFSGSGSGTDFSLNIHPMEEDDTAMYFC

SEQ ID NO: 104 - protein, 111 aa, Artificial Sequence
  Synthetic peptide sequence
DIVLTQSPASLAVSLGQRATISCRAGESVDNFDISFMNWFQQKPGQPPKLLIYAASNQGSGVPARFSGSGSGTDFSLNIHPMEEDDTAMYFCQQSKEVPYTFGGGTKLEIK

SEQ ID NO: 105 - protein, 15 aa, Artificial Sequence
  Synthetic peptide sequence
RAGESVDNFDISFMN

SEQ ID NO: 106 - protein, 110 aa, Artificial Sequence
  Synthetic peptide sequence
DIVLTQSPASLAVSLGQRATISCRASESVDYYGTSLMQWYQQKPGQPPKLLIYAASNVESGVPARFSGSGSGTDFSLNIHPVEEDDIAMYFCQQTRKVYTFGGGTKLEIK

SEQ ID NO: 107 - protein, 15 aa, Artificial Sequence
  Synthetic peptide sequence
RASESVDYYGTSLMQ

SEQ ID NO: 108 - protein, 7 aa, Artificial Sequence
  Synthetic peptide sequence
AASNVES

SEQ ID NO: 109 - protein, 8 aa, Artificial Sequence
  Synthetic peptide sequence
QQTRKVYT

SEQ ID NO: 110 - protein, 15 aa, Artificial Sequence
  Synthetic peptide sequence
WYQQKPGQPPKLLIY

SEQ ID NO: 111 - protein, 32 aa, Artificial Sequence
  Synthetic peptide sequence
GVPARFSGSGSGTDFSLNIHPVEEDDIAMYFC

SEQ ID NO: 112 - protein, 111 aa, Artificial Sequence
  Synthetic Construct
DIVMTQSPASLAVSLGQRATISCRASKGVTTSGYSYMHWYQQKPGQPPKLLIYLASNLESGVPARFSGSGSGTDFTLNIHPVEEEDAATYYCQHSREFPLTFGAGTKLELK

SEQ ID NO: 113 - protein, 15 aa, Artificial Sequence
  Synthetic peptide sequence
RASKGVTTSGYSYMH

SEQ ID NO: 114 - protein, 7 aa, Artificial Sequence
  Synthetic peptide sequence
LASNLES

SEQ ID NO: 115 - protein, 9 aa, Artificial Sequence
  Synthetic peptide sequence
QHSREFPLT

SEQ ID NO: 116 - protein, 23 aa, Artificial Sequence
  Synthetic peptide sequence
DIVMTQSPASLAVSLGQRATISC

SEQ ID NO: 117 - protein, 32 aa, Artificial Sequence
  Synthetic peptide sequence
GVPARFSGSGSGTDFTLNIHPVEEEDAATYYC

SEQ ID NO: 118 - protein, 10 aa, Artificial Sequence
  Synthetic peptide sequence
FGAGTKLELK

SEQ ID NO: 119 - protein, 112 aa, Artificial Sequence
  Synthetic peptide sequence
DIVMTQSPSSLAVSVGEKVTVSCKSSQSLLYSSNQKNYLAWYQQRPGQSPKLLIYWASTRESGVPDRFTGSGSGTDFTLSISSVKAEDLAVYYCQQYYSYPTFGGGTKLEIK

SEQ ID NO: 120 - protein, 17 aa, Artificial Sequence
  Synthetic peptide sequence
KSSQSLLYSSNQKNYLA

SEQ ID NO: 121 - protein, 8 aa, Artificial Sequence
  Synthetic peptide sequence
QQYYSYPT

SEQ ID NO: 122 - protein, 23 aa, Artificial Sequence
  Synthetic peptide sequence
DIVMTQSPSSLAVSVGEKVTVSC

SEQ ID NO: 123 - protein, 15 aa, Artificial Sequence
  Synthetic peptide sequence
WYQQRPGQSPKLLIY

SEQ ID NO: 124 - protein, 32 aa, Artificial Sequence
  Synthetic peptide sequence
GVPDRFTGSGSGTDFTLSISSVKAEDLAVYYC

SEQ ID NO: 125 - protein, 111 aa, Artificial Sequence
  Synthetic peptide sequence
DIQLTQSPSSLSASVGDRVTITCRASESVDNYGISFMNWFQQKPGKAPKLLIYAASNPGSGVPSRFSGSGSGTDFTLTISSLQPEDFATYYCQQSKEVPYTFGQGTKLEIK

SEQ ID NO: 126 - protein, 23 aa, Artificial Sequence
  Synthetic peptide sequence
DIQLTQSPSSLSASVGDRVTITC

SEQ ID NO: 127 - protein, 15 aa, Artificial Sequence
  Synthetic peptide sequence
WFQQKPGKAPKLLIY

SEQ ID NO: 128 - protein, 10 aa, Artificial Sequence
  Synthetic peptide sequence
FGQGTKLEIK

SEQ ID NO: 129 - protein, 111 aa, Artificial Sequence
  Synthetic peptide sequence
EIVLTQSPATLSLSPGERATLSCRASESVDNYGISFMNWYQQKPGQAPRLLIYAASNPGSGIPARFSGSGSGTDFTLTISSLEPEDFAVYYCQQSKEVPYTFGQGTKVEIK

SEQ ID NO: 130 - protein, 23 aa, Artificial Sequence
  Synthetic peptide sequence
EIVLTQSPATLSLSPGERATLSC

SEQ ID NO: 131 - protein, 15 aa, Artificial Sequence
  Synthetic peptide sequence
WYQQKPGQAPRLLIY

SEQ ID NO: 132 - protein, 32 aa, Artificial Sequence
  Synthetic peptide sequence
GIPARFSGSGSGTDFTLTISSLEPEDFAVYYC

SEQ ID NO: 133 - protein, 10 aa, Artificial Sequence
  Synthetic peptide sequence
FGQGTKVEIK

SEQ ID NO: 134 - protein, 112 aa, Artificial Sequence
  Synthetic peptide sequence
DIQMTQSPSSLSASVGDRVTITCKSSQSLLYSSNQKNYLAWYQQKPGKSPKLLIYWASTRESGVPSRFSGSGSGTDFTLTISSLQPEDFATYYCQQYYSYPTFGGGTKVEIK

SEQ ID NO: 135 - protein, 15 aa, Artificial Sequence
  Synthetic peptide sequence
WYQQKPGKSPKLLIY

SEQ ID NO: 136 - protein, 110 aa, Artificial Sequence
  Synthetic peptide sequence
DIQMTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIK

SEQ ID NO: 137 - protein, 110 aa, Artificial Sequence
  Synthetic peptide sequence
DIQLTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIK

SEQ ID NO: 138 - protein, 110 aa, Artificial Sequence
  Synthetic peptide sequence
DIQLTQSPSSLSASVGDRVTITCRASESVDYYGTSLMQWYQQKPGKPPKLLIYAASNVESGVPSRFSGSGSGTDFTLTISSLQPEDFATYYCQQTRKVYTFGQGTKLEIK

SEQ ID NO: 139 - protein, 15 aa, Artificial Sequence
  Synthetic peptide sequence
WYQQKPGKPPKLLIY

SEQ ID NO: 140 - protein, 110 aa, Artificial Sequence
  Synthetic peptide sequence
DIQLTQSPSSLSASVGDRVTITCRASESVDYYGTSLMQWYQQKPGKAPKLLIYAASKRYSGVPSRFSGSGSGTDFTLTISSLQPEDFATYYCQQTRKAYTFGQGTKLEIK

SEQ ID NO: 141 - protein, 7 aa, Artificial Sequene
  Synthetic peptide sequence
AASKRYS

SEQ ID NO: 142 - protein, 8 aa, Artificial Sequence
  Synthetic Construct
QQTRKAYT

SEQ ID NO: 143 - protein, 110 aa, Artificial Sequence
  Synthetic peptide sequence
DIQLTQSPSSLSASVGDRVTITCRASESVDYYGTSLMQWYQQKPGKAPKLLIYAASKLWSGVPSRFSGSGSGTDFTLTISSLQPEDFATYYCQQTRKVYTFGQGTKLEIK

SEQ ID NO: 144 - protein, 7 aa, Artificial Sequence
  Synthetic peptide sequence
AASKLWS

SEQ ID NO: 145 - protein, 110 aa, Artificial Sequence
  Synthetic peptide sequence
DIQLTQSPSSLSASVGDRVTITCRASESVDYYGTSLMQWYQQKPGKAPKLLIYAASKVAPGVPSRFSGSGSGTDFTLTISSLQPEDFATYYCQQTRKAYTFGQGTKLEIK

SEQ ID NO: 146 - protein, 7 aa, Artificial Sequence
  Synthetic peptide sequence
AASKVAP

SEQ ID NO: 147 - protein, 110 aa, Artificial Sequence
  Synthetic peptide sequence
DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIK

SEQ ID NO: 148 - protein, 15 aa, Artificial Sequence
  Synthetic peptide sequence
RASESVDYYGSSLLQ

SEQ ID NO: 149 - protein, 7 aa, Artificial Sequence
  Synthetic peptide sequence
AASKLAS

SEQ ID NO: 150 - protein, 110 aa, Artificial Sequence
  Synthetic peptide sequence
DIQLTQSPSSLSASVGDRVTITCRASESVDYYGTSLMQWYQQKPGKAPKLLIYAASNIAPGVPSRFSGSGSGTDFTLTISSLQPEDFATYYCQQTRKAYTFGQGTKLEIK

SEQ ID NO: 151 - protein, 7 aa, Artificial Sequence
  Synthetic peptide sequence
AASNIAP

SEQ ID NO: 152 - protein, 110 aa, Artificial Sequence
  Synthetic peptide sequence
DIQLTQSPSSLSASVGDRVTITCRASESVDYYGSSLMQWYQQKPGKAPKLLIYAASKRYSGVPSRFSGSGSGTDFTLTISSLQPEDFATYYCQQTRKEYTFGQGTKLKIK

SEQ ID NO: 153 - protein, 15 aa, Artificial Sequence
  Synthetic peptide sequence
RASESVDYYGSSLMQ

SEQ ID NO: 154 - protein, 8 aa, Artificial Sequence
  Synthetic peptide sequence
QQTRKEYT

SEQ ID NO: 155 - protein, 10 aa, Artificial Sequence
  Synthetic peptide sequence
FGQGTKLKIK

SEQ ID NO: 156 - protein, 110 aa, Artificial Sequence
  Synthetic peptide sequence
DIQLTQSPSSLSASVGDRVTITCRASESVDYYGSSLMQWYQQKPGKAPKLLIYAASNVAPGVPSRFSGSGSGTDFTLTISSLQPEDFATYYCQQTRKAYTFGQGTKLEIK

SEQ ID NO: 157 - protein, 7 aa, Artificial Sequence
  Synthetic peptide sequence
AASNVAP

SEQ ID NO: 158 - protein, 110 aa, Artificial Sequence
  Synthetic peptide sequence
DIQLTQSPSSLSASVGDRVTITCRASESVDYYGSSLMQWYQQKPGKAPKLLIYAASHRASGVPSRFSGSGSGTDFTLTISSLQPEDFATYYCQQTRKAYTFGQGTKLEIK

SEQ ID NO: 159 - protein, 7 aa, Artificial Sequence
  Synthetic Construct
AASHRAS

SEQ ID NO: 160 - protein, 110 aa, Artificial Sequence
  Synthetic peptide sequence
DIQLTQSPSSLSASVGDRVTITCRASESVDYYGTSLMQWYQQKPGKAPKLLIYAASNVASGVPSRFSGSGSGTDFTLTISSLQPEDFATYYCQQTRKEYTFGQGTKLEIK

SEQ ID NO: 161 - protein, 7 aa, Artificial Sequence
  Synthetic peptide sequence
AASNVAS

SEQ ID NO: 162 - protein, 110 aa, Artificial Sequence
  Synthetic Construct
DIQLTQSPSSLSASVGDRVTITCRASESVDYYGHSLMQWYQQKPGKAPKLLIYAASNRYSGVPSRFSGSGSGTDFTLTISSLQPEDFATYYCQQTRKAYSFGQGTKLEIK

SEQ ID NO: 163 - protein, 15 aa, Artificial Sequence
  Synthetic peptide sequence
RASESVDYYGHSLMQ

SEQ ID NO: 164 - protein, 7 aa, Artificial Sequence
  Synthetic peptide sequence
AASNRYS

SEQ ID NO: 165 - protein, 8 aa, Artificial Sequence
  Synthetic peptide sequence
QQTRKAYS

SEQ ID NO: 166 - protein, 110 aa, Artificial Sequence
  Synthetic peptide sequence
DIQMTQSPSSLSASVGDRVTITCRASQSVDYYGSSLLQWYQQKPGKAPKLLIYDASKLASGVPSRFSGSGSGTDFTLTISSLQPEDFATYYCQQERKAYTFGQGTKLEIK

SEQ ID NO: 167 - protein, 15 aa, Artificial Sequence
  Synthetic peptide sequence
RASQSVDYYGSSLLQ

SEQ ID NO: 168 - protein, 7 aa, Artificial Sequence
  Synthetic peptide sequence
DASKLAS

SEQ ID NO: 169 - protein, 8 aa, Artificial Sequence
  Synthetic peptide sequence
QQERKAYT

SEQ ID NO: 170 - protein, 110 aa, Artificial Sequence
  Synthetic peptide sequence
DIQMTQSPSSLSASVGDRVTITCRASQSVDYYGSSLLQWYQQKPGKAPKLLIYAASKLASGVPSRFSGSGSGTDFTLTISSLQPEDFATYYCQQERKAYTFGQGTKLEIK

SEQ ID NO: 171 - protein, 110 aa, Artificial Sequence
  Synthetic peptide sequence
DIQMTQSPSSLSASVGDRVTITCRASQSVDYYGSSLLQWYQQKPGKAPKLLIYDASKLASGVPSRFSGSGSGTDFTLTISSLQPEDFATYYCQQTRKAYTFGQGTKLEIK

SEQ ID NO: 172 - protein, 110 aa, Artificial Sequence
  Synthetic peptide sequence
DIQMTQSPSSLSASVGDRVTITCRASQSVDYYGSSLLQWYQQKPGKAPKLLIYAASKLASGVPSRFSGSGSGTDFTLTISSLQPEDFATYYCQQTRKAYTFGQGTKLEIK

SEQ ID NO: 173 - protein, 110 aa, Artificial Sequence
  Synthetic peptide sequence
DIQLTQSPSSLSASVGDRVTITCRASESVDYYGSSLLQWYQQKPGKAPKLLIYDASKLASGVPSRFSGSGSGTDFTLTISSLQPEDFATYYCQQERKAYTFGQGTKLEIK

SEQ ID NO: 174 - protein, 110 aa, Artificial Sequence
  Synthetic peptide sequence
DIQLTQSPSSLSASVGDRVTITCRASESVDYYGSSLLQWYQQKPGKAPKLLIYAASKLASGVPSRFSGSGSGTDFTLTISSLQPEDFATYYCQQERKAYTFGQGTKLEIK

SEQ ID NO: 175 - protein, 110 aa, Artificial Sequence
  Synthetic peptide sequence
DIQLTQSPSSLSASVGDRVTITCRASESVDYYGSSLLQWYQQKPGKAPKLLIYDASKLASGVPSRFSGSGSGTDFTLTISSLQPEDFATYYCQQTRKAYTFGQGTKLEIK

SEQ ID NO: 176 - protein, 107 aa, Artificial Sequence
  Synthetic peptide sequence
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARYYYYYGMDV

SEQ ID NO: 177 - protein, 10 aa, Artificial Sequence
  Synthetic peptide sequence
GFTFSSYWMS

SEQ ID NO: 178 - protein, 17 aa, Artificial Sequence
  Synthetic peptide sequence
NIKQDGSEKYYVDSVKG

SEQ ID NO: 179 - protein, 9 aa, Artificial Sequence
  Synthetic peptide sequence
YYYYYGMDV

SEQ ID NO: 180 - protein, 107 aa, Artificial Sequence
  Synthetic peptide sequence
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 181 - protein, 11 aa, Artificial Sequence
  Synthetic peptide sequence
RASQSISSYLN

SEQ ID NO: 182 - protein, 7 aa, Artificial Sequence
  Synthetic peptide sequence
AASSLQS

SEQ ID NO: 183 - protein, 9 aa, Artificial Sequence
  Synthetic peptide sequence
QQSYSTPYT

SEQ ID NO: 184 - protein, 107 aa, Homo sapiens [sequence omitted]

SEQ ID NO: 185 - protein, 98 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 186 - protein, 15 aa, Homo sapiens
EPKSCDKTHTCPPCP

SEQ ID NO: 187 - protein, 217 aa, Homo sapiens
APEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 216 aa, Artificial Sequence
  Synthetic peptide sequence
APEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 189 - protein, 216 aa, Artificial Sequence
  Synthetic peptide sequence
APEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 190 - protein, 8 aa, Artificial Sequence
  Synthetic peptide sequence
GGGSGGGG

SEQ ID NO: 191 - protein, 9 aa, Artificial Sequence
  Synthetic peptide sequence
GGGGSGGGG

SEQ ID NO: 192 - protein, 6 aa, Artificial Sequence
  Synthetic peptide sequence
GCPPCP

SEQ ID NO: 193 - protein, 16 aa, Artificial Sequence
  Synthetic peptide sequence
GGGGSGGGGSGGGGSG

SEQ ID NO: 194 - protein, 5 aa, Artificial Sequence
  Synthetic peptide sequence
RTSDQ

SEQ ID NO: 195 - protein, 15 aa, Artificial Sequence
  Synthetic peptide sequence
EPKSSDKTHTCPPCP

SEQ ID NO: 196 - protein, 462 aa, Artificial Sequence
  Synthetic peptide sequence
DIVLTQSPASLAVSLGQRATISCRASESVDNYGISFMNWFQQKPGQPPKLLIYAASNPGSGVPARFSGSGSGTDFSLNIHPLEEDDTAMFFCQQSKEVPYTFGGGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 197 - protein, 456 aa, Artificial Sequence
  Synthetic peptide sequence
DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLQQSGAELARPGASVNLSCKASGYTFTTYWMQWVKQRPGQGLEWIGAIYPGDGMTTYTQKFKDKATLTADKSSSTAYMQLSSLASEDSAVYYCVRKGMDYWGQGTSVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 198 - protein, 918 aa, Artificial Sequence
  Synthetic peptide sequence
DIVLTQSPASLAVSLGQRATISCRASESVDNYGISFMNWFQQKPGQPPKLLIYAASNPGSGVPARFSGSGSGTDFSLNIHPLEEDDTAMFFCQQSKEVPYTFGGGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLQQSGAELARPGASVNLSCKASGYTFTTYWMQWVKQRPGQGLEWIGAIYPGDGMTTYTQKFKDKATLTADKSSSTAYMQLSSLASEDSAVYYCVRKGMDYWGQGTSVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 199 - protein, 461 aa, Artificial Sequence
  Synthetic peptide sequence
DIVLTQSPASLAVSLGQRATISCRASESVDYYGTSLMQWYQQKPGQPPKLLIYAASNVESGVPARFSGSGSGTDFSLNIHPVEEDDIAMYFCQQTRKVYTFGGGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 200 - protein, 464 aa, Artificial Sequence
  Synthetic peptide sequence
DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGQVQLQQPGAELVKPGASVKLSCKASGYTFTSYWMHWVKQRPGQGLEWIGEIKPSNGLTNYIEKFKNKATLTVDKSATTAYMQLSSLTAEDSAVYYCTRTITTTEGYWFFDVWGAGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 201 - protein, 925 aa, Artificial Sequence
  Synthetic peptide sequence
DIVLTQSPASLAVSLGQRATISCRASESVDYYGTSLMQWYQQKPGQPPKLLIYAASNVESGVPARFSGSGSGTDFSLNIHPVEEDDIAMYFCQQTRKVYTFGGGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGQVQLQQPGAELVKPGASVKLSCKASGYTFTSYWMHWVKQRPGQGLEWIGEIKPSNGLTNYIEKFKNKATLTVDKSATTAYMQLSSLTAEDSAVYYCTRTITTTEGYWFFDVWGAGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 202 - protein, 463 aa, Artificial Sequence
  Synthetic peptide sequence
DIVMTQSPSSLAVSVGEKVTVSCKSSQSLLYSSNQKNYLAWYQQRPGQSPKLLIYWASTRESGVPDRFTGSGSGTDFTLSISSVKAEDLAVYYCQQYYSYPTFGGGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 203 - protein, 465 aa, Artificial Sequence
  Synthetic peptide sequence
DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLQQSGPELVKPGASVKISCKASGYSFTDYIMLWVKQSHGKSLEWIGNSNPYYGSTSYNLKFKGKATLTVDKSSSTAYMHLNSLTSEDSAVYYCARSGYYGSSPYWYFDVWGAGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 204 - protein, 928 aa, Artificial Sequence
  Synthetic peptide sequence
DIVMTQSPSSLAVSVGEKVTVSCKSSQSLLYSSNQKNYLAWYQQRPGQSPKLLIYWASTRESGVPDRFTGSGSGTDFTLSISSVKAEDLAVYYCQQYYSYPTFGGGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLQQSGPELVKPGASVKISCKASGYSFTDYIMLWVKQSHGKSLEWIGNSNPYYGSTSYNLKFKGKATLTVDKSSSTAYMHLNSLTSEDSAVYYCARSGYYGSSPYWYFDVWGAGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 205 - protein, 462 aa, Artificial Sequence
  Synthetic peptide sequence
DIQLTQSPSSLSASVGDRVTITCRASESVDNYGISFMNWFQQKPGKAPKLLIYAASNPGSGVPSRFSGSGSGTDFTLTISSLQPEDFATYYCQQSKEVPYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 206 - protein, 456 aa, Artificial Sequence
  Synthetic peptide sequence
DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLVESGGGLVQPGGSLRLSCAASGYTFTTYWMQWVRQAPGKGLEWIGAIYPGDGMTTYTQKFKDRFTISADKAKNSAYLQMNSLRAEDTAVYYCVRKGMDYWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 207 - protein, 918 aa, Artificial Sequence
  Synthetic peptide sequence
DIQLTQSPSSLSASVGDRVTITCRASESVDNYGISFMNWFQQKPGKAPKLLIYAASNPGSGVPSRFSGSGSGTDFTLTISSLQPEDFATYYCQQSKEVPYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLVESGGGLVQPGGSLRLSCAASGYTFTTYWMQWVRQAPGKGLEWIGAIYPGDGMTTYTQKFKDRFTISADKAKNSAYLQMNSLRAEDTAVYYCVRKGMDYWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 208 - protein, 217 aa, Artificial Sequence
  Synthetic peptide sequence
DIQLTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 209 - protein, 451 aa, Artificial Sequene
  Synthetic peptide sequence
EVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 210 - protein, 461 aa, Artificial Sequence
  Synthetic peptide sequence
DIQLTQSPSSLSASVGDRVTITCRASESVDYYGTSLMQWYQQKPGKPPKLLIYAASNVESGVPSRFSGSGSGTDFTLTISSLQPEDFATYYCQQTRKVYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 211 - protein, 464 aa, Artificial Sequence
  Synthetic peptide sequence
DIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 212 - protein, 925 aa, Artificial Sequence
  Synthetic peptide sequence
DIQLTQSPSSLSASVGDRVTITCRASESVDYYGTSLMQWYQQKPGKPPKLLIYAASNVESGVPSRFSGSGSGTDFTLTISSLQPEDFATYYCQQTRKVYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIVMTQSPDSLAVSLGERATINCKSSQSLFNVRSRKNYLAWYQQKPGQPPKLLISWASTRESGVPDRFSGSGSGTDFTLTISSLQAEDVAVYYCKQSYDLFTFGSGTKLEIKGGGSGGGGEVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 213 - protein, 483 aa, Artificial Sequence
  Synthetic peptide sequence
EVQLVESGGGLVQPGGSLRLSCAASGYTFTSYWMHWVRQAPGKGLEWIGEIKPSNGLTNVHEKFKNRFTISVDKAKNSAYLQMNSLRAEDTAVYYCTRTITTTEGYWFFDVWGQGTLVTVSSGGGGSGGGGSGGGGSGDIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKRTSDQEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 214 - protein, 217 aa, Artificial Sequence
  Synthetic peptide sequence
DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 215 - protein, 451 aa, Artificial Sequence
  Synthetic peptide sequence
EVQLVESGGGLVQPGGSLRLSCAASGYTFTSYWMHWVRQAPGKGLEWIGEIKPSNGLTNVHEKFKNRFTISVDKAKNSAYLQMNSLRAEDTAVYYCTRTITTTEGYWFFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 216 - protein, 461 aa, Artificial Sequence
  Synthetic peptide sequence
DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 217 - protein, 465 aa, Artificial Sequence
  Synthetic peptide sequence
DIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIKGGGGSGGGGEVQLVESGGGLVQPGGSLRLSCAASGYTFTSYWMHWVRQAPGKGLEWIGEIKPSNGLTNVHEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 218 - protein, 926 aa, Artificial Sequence
  Synthetic peptide sequence
DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIKGGGGSGGGGEVQLVESGGGLVQPGGSLRLSCAASGYTFTSYWMHWVRQAPGKGLEWIGEIKPSNGLTNVHEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 219 - protein, 10 aa, Homo sapiens
EPKSSDKTHT

SEQ ID NO: 220 - protein, 465 aa, Artificial Sequence
  Synthetic peptide sequence
DIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 221 - protein, 926 aa, Artificial Sequence
  Synthetic peptide sequence
DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 222 - protein, 5 aa, Homo sapiens
CPPCP

SEQ ID NO: 223 - protein, 451 aa, Artificial Sequence
  Synthetic peptide sequence
EVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 224 - protein, 1080 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYLEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYFTRTRPLEQKLISEEDLAANDILDYKDDDDK

SEQ ID NO: 225 - DNA, 3240 bp, Homo sapiens
tcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtacttggaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcattctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctattttacgcgtacgcggccgctcgagcagaaactcatctcagaagaggatctggcagcaaatgatatcctggattacaaggatgacgacgataag

SEQ ID NO: 226 - protein, 1080 aa, Macaca fascicularis
SQVSQNCHNGSYEISVLMMDNSAFAEPLENVEDAVNEGLEIVRGRLQNAGLNVTVNASFMYSDGLIHNSGDCRSSTCEGLDLLRKISNAKRMGCVLMGPSCTYSTFQMYLDTELSYPMISAGSFGLSCDYKETLTRLMSPARKLTYFLVNFWKTNDLPFKTYSWSTSYVYKNGTESEDCFWYLNALEASVSYFSHELSFKLVLRQDKEFQDILMDHNRKSNVIVMCGDPEFLYKLKGDRAVAEDIVIILVDLFNDQYFEDNVTAPDYMKNVLVLTQSPGNSLLNSSFSRNLSPTKRDFALAYLNGILLFGHMLKTFLENGENITTPKFAHAFRNLTFEGYDGPVTLDDWGDVDSTMVLLYTSVDTKKYKVLLTYDTHVNQTNPVDMSPTFTWKNSKLPNDITDRGPQILMIAVFTLTGAVVLLLLVALLMLRKYKKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANVSQKGDVYSYGIIAQEIILRKETFYTSSCRDRNEKIFRVENSNGMKPFRPDLFLETAEEKELEVYLLVKSCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYFTRTRPLEQKLISEEDLAANDILDYKDDDDK

SEQ ID NO: 227 - DNA, 3240 bp, Macaca fascicularis
tcacaggtgagtcagaactgccacaatggcagctatgaaatcagcgtcctgatgatggacaactcagcctttgcagagcccctggaaaacgtggaagatgcggtgaatgaggggctggaaatagtgagaggacgtctgcaaaacgctggcctaaatgtgactgtgaatgcttctttcatgtattcggatggtctgattcataactccggcgactgccggagcagcacctgtgaaggccttgacctactcaggaaaatttcaaatgcaaaacggatgggctgtgtcctcatggggccctcatgtacatactccaccttccagatgtaccttgacacagaattgagctaccccatgatctcagctggaagttttggattgtcatgtgactataaagaaaccttaaccaggctgatgtctccagctagaaagttgacatacttcttggttaacttttggaaaaccaatgatctacccttcaaaacttattcctggagcacttcgtatgtttacaagaatggtacggagtccgaggactgtttctggtaccttaacgctctggaggccagtgtttcctatttctcccacgaactcagttttaagttggtgttaagacaagataaggagtttcaggatatcttaatggaccacaacaggaaaagcaatgtgattgttatgtgtggtgatccagagttcctctacaagttgaagggtgaccgagcagtggctgaagacattgtcattattctagtggatcttttcaatgaccagtactttgaggacaatgtcacagcccctgactatatgaaaaatgtccttgttctgacgcagtctcctggcaattccctcctaaatagctctttctccaggaatctatccccaacaaaacgagactttgctcttgcctatttgaatggaatcctgctctttggacatatgctaaagacatttcttgaaaatggagaaaatattaccacccccaaatttgctcatgctttcaggaatctcacttttgaagggtatgacggtccagtgaccttggatgactggggggatgtggacagtaccatggtgcttctgtatacgtctgtggacaccaagaaatacaaggttcttttgacctatgatacccacgtaaatcagaccaaccctgtggatatgagccccacattcacttggaagaactctaaacttcctaatgatattacagaccggggccctcagatcctgatgattgcagtcttcaccctcaccggagctgtggtgctgctcctgcttgtcgctctcctgatgctcagaaaatataaaaaagattatgaacttcgtcagaaaaaatggtcccacattcctcctgaaaatatctttcctctggagaccaatgagaccaatcacgttagcctgaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctatggcaccgtgaaacttgataccatgatcttcggggtgatagaatactgtgagagaggatccctccgggaagttttaaatgacacaatttcctaccctgatggcacattcatggattgggagtttaagatctctgtcctgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaagacctgtggacagctccagagcacctccgccaagccaacgtctctcagaaaggagatgtgtacagctacgggatcatcgcacaggagatcatcctgcggaaagaaaccttctacacttcgagctgtcgagaccggaacgagaagattttcagagtggaaaattccaatggaatgaaacccttccgtccagatttattcttggaaacggcagaggaaaaagagctagaagtgtacctacttgtaaaaagctgttgggaagaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctatacaaggcagagagggacagggctgacagacttaactttatgttgcttccaaggctagtggtaaagtctctgaaggagaaaggctttgtagagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccattggtgatgcctacatggtggctagtggtttgcctaagagaaatggcaatcggcatgcaatagacattgccaagatggccttggaaatcctcagcttcatggggacctttgagctggagcatcttcctggcctcccaatatggattcgcattggcgttcactctggtccctgcgctgctggagttgtgggaatcaagatgcctcgttattgtctatttggagatacagtcaacacagcctctaggatggaatccactggcctccctttgaggattcatgtgagtggctccaccatagccattctgaagagaactgagtgccagttcctgtatgaagtgagaggagaaacgtacttaaagggaagaggaaatgagactacctactggctgaccgggatgaaggaccagaaattcaacctgccaacccctcctactgtggagaatcaacagcgtttgcaagcagaattttcagacatgattgccaactctttacagaaaagacaggcggcagggataagaagccaaaaacccagacgagtagccagctataaaaaaggcactctggaatacttgcaactgaataccacggacaaggagagcacctattttacgcgtactcggccgctcgagcagaaactcatctcagaagaggatctggcagcaaatgatatcctggattacaaggatgacgacgataag

SEQ ID NO: 228 - protein, 1083 aa, Mus musculus
VFWASQVRQNCRNGSYEISVLMMDNSAYKEPMQNLREAVEEGLDIVRKRLREADLNVTVNATFIYSDGLIHKSGDCRSSTCEGLDLLREITRDHKMGCALMGPSCTYSTFQMYLDTELNYPMISAGSYGLSCDYKETLTRILPPARKLMYFLVDFWKVNNASFKPFSWNSSYVYKNGSEPEDCFWYLNALEAGVSYFSEVLNFKDVLRRSEQFQEILTGHNRKSNVIVMCGTPESFYDVKGDLQVAEDTVVILVDLFSNHYFEENTTAPEYMDNVLVLTLPSEQSTSNTSVAERFSSGRSDFSLAYLEGTLLFGHMLQTFLENGENVTGPKFARAFRNLTFQGFAGPVTLDDSGDIDNIMSLLYVSLDTRKYKVLMKYDTHKNKTIPVAENPNFIWKNHKLPNDVPGLGPQILMIAVFTLTGILVVLLLIALLVLRKYRRDHALRQKKWSHIPSENIFPLETNETNHISLKIDDDRRRDTIQRVRQCKYDKKKVILKDLKHSDGNFSEKQKIDLNKLLQSDYYNLTKFYGTVKLDTRIFGVVEYCERGSLREVLNDTISYPDGTFMDWEFKISVLNDIAKGMSYLHSSKIEVHGRLKSTNCVVDSRMVVKITDFGCNSILPPKKDLWTAPEHLRQATISQKGDVYSFAIIAQEIILRKETFYTLSCRDHNEKIFRVENSYGKPFRPDLFLETADEKELEVYLLVKSCWEEDPEKRPDFKKIESTLAKIFGLFHDQKNESYMDTLIRRLQLYSRNLEHLVEERTQLYKAERDRADHLNFMLLPRLVVKSLKEKGIVEPELYEEVTIYFSDIVGFTTICKYSTPMEVVDMLNDIYKSFDQIVDHHDVYKVETIGDAYVVASGLPMRNGNRHAVDISKMALDILSFIGTFELEHLPGLPVWIRIGVHSGPCAAGVVGIKMPRYCLFGDTVNTASRMESTGLPLRIHMSSSTITILKRTDCQFLYEVRGETYLKGRGTETTYWLTGMKDQEYNLPSPPTVENQQRLQTEFSDMIVSALQKRQASGKKSRRPTRVASYKKGFLEYMQLNNSDHDSTYFTRTRPLEQKLISEEDLAANDILDYKDDDDK

SEQ ID NO: 229 - DNA, 3249 bp, Mus musculus
gtgttctgggcctctcaggtgaggcagaactgccgcaatggcagctacgagatcagcgtcctgatgatggacaactcagcctacaaagaacctatgcaaaacctgagggaggctgtggaggaaggactggacatagtgcgaaagcgcctgcgtgaagccgacctaaatgtgactgtgaacgcgactttcatctactccgacggtctgattcataagtcaggtgactgccggagcagcacctgtgaaggccttgacctactcagggagattacaagagatcataagatgggctgcgccctcatggggccctcgtgcacgtattccaccttccagatgtacctcgacacagagttgaactatcccatgatttccgctggaagttatggattgtcctgtgactataaggaaaccctaaccaggatcctgcctccagccaggaagctgatgtacttcttggtcgatttctggaaagtcaacaatgcatctttcaaacccttttcctggaactcttcgtatgtttacaagaatggatcggaacctgaagattgtttctggtacctcaatgctctggaggctggggtgtcctatttttctgaggtgctcaacttcaaggatgtactgagacgcagcgaacagttccaggaaatcttaacaggccataacagaaagagcaatgtgattgttatgtgtggcacgccagaaagcttctatgatgtgaaaggtgacctccaagtggctgaagatactgttgtcatcctggtagatctgttcagtaaccattactttgaggagaacaccacagctcctgagtatatggacaatgtcctcgtcctgacgctgccgtctgaacagtccacctcaaacacctctgtcgccgagaggttttcatcggggagaagtgacttttctctcgcttacttggagggaaccttgctatttggacacatgctgcagacgtttcttgaaaatggagaaaatgtcacgggtcccaagtttgctcgtgcattcaggaatctcacttttcaaggctttgcaggacctgtgactctggatgacagtggggacattgacaacattatgtcccttctgtatgtgtctctggataccaggaaatacaaggttcttatgaagtatgacacccacaaaaacaaaactattccggtggctgagaaccccaacttcatctggaagaaccacaagctccccaatgacgttcctgggctgggccctcaaatcctgatgattgccgtcttcacgctcacggggatcctggtagttctgctgctgattgccctcctcgtgctgagaaaatacagaagagatcatgcacttcgacagaagaaatggtcccacattccttctgaaaacatctttcctctggagaccaacgagaccaaccacatcagcctgaagattgacgatgacaggagacgagacacaatccagagagtgcgacagtgcaaatacgacaagaagaaagtgattctgaaagacctcaagcacagcgacgggaacttcagtgagaagcagaagatagacctgaacaagttgctgcagtctgactactacaacctgactaagttctacggcaccgtgaagctggacaccaggatctttggggtggttgagtactgcgagaggggatccctccgggaagtgttaaacgacacaatttcctaccctgacggcacgttcatggattgggagtttaagatctctgtcttaaatgacatcgctaaggggatgtcctacctgcactccagtaagattgaagtccacgggcgtctcaaatccaccaactgcgtggtggacagccgcatggtggtgaagatcaccgactttgggtgcaattccatcctgcctccaaaaaaagacctgtggacggccccggagcacctgcgccaggccaccatctctcagaaaggagacgtgtacagcttcgccatcattgcccaggagatcatcctccgtaaggagactttttacacgctgagctgtcgggatcacaatgagaagattttcagagtggaaaattcatacgggaaacctttccgcccagacctcttcctggagactgcagatgagaaggagctggaggtctatctacttgtcaaaagctgttgggaggaggatccagaaaagaggccagatttcaagaaaatcgagagcacactggccaagatatttggccttttccatgaccagaaaaacgagtcttacatggacaccttgatccgacgtctccagctgtactctcgaaacctggaacatctggtggaggaaaggactcagctgtacaaggcggagagggacagggctgaccaccttaacttcatgctcctcccacggctggtggtaaagtcactgaaggagaaaggcatcgtggagccagagctgtacgaagaagtcacaatctacttcagtgacattgtgggcttcaccaccatctgcaagtatagcacgcccatggaggtggtggacatgctcaacgacatctacaagagctttgaccagattgtggaccaccatgacgtctacaaggtagaaaccatcggtgacgcctacgtggtggccagcggtctgcctatgagaaacggcaaccgacacgcggtagacatttccaagatggccttggacatcctcagcttcatagggacctttgagttggagcatctccctggcctccccgtgtggatccgcattggagttcattctgggccctgcgctgctggtgttgtggggatcaagatgcctcgctattgcctgtttggagacactgtcaacactgcctccaggatggaatccaccggcctccccttgaggattcacatgagcagctccaccataaccatcctgaagagaacggattgccagttcctgtatgaagtgaggggagaaacctacttaaagggaagagggacagagaccacatactggctgactgggatgaaggaccaagaatacaacctgccatccccaccgacagtggagaaccaacagcgtctgcagactgagttctcagacatgatcgttagcgccttacagaaaagacaggcctcgggcaagaagagccggaggcccactcgggtggccagctacaagaaaggctttctggaatacatgcagctgaacaattcagaccacgatagcacctattttacgcgtacgcggccgctcgagcagaaactcatctcagaagaggatctggcagcaaatgatatcctggattacaaggatgacgacgataag

SEQ ID NO: 230 - protein, 672 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQGGGGSENLYFQGGGGSGGGGSEPRGPTIKPCPPCKCPAPNLEGGPSVFIFPPKIKDVLMISLSPIVTCVVVDVSEDDPDVQISWFVNNVEVHTAQTQTHREDYNSTLRVVSALPIQHQDWMSGKAFACAVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGGGPPDYKDDDDK

SEQ ID NO: 231 - DNA, 2076 bp, Homo sapiens
atggagacagacacactgctcctgtgggtgctgcttctgtgggtgccaggttccactggatcacaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagggaggcggaggttccgagaatttatacttccagggcggaggcggttccggcggcggaggaagcgagccccgcggaccgacaatcaagccctgtcctccatgcaaatgcccagcacctaacctcgagggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggctttcgcatgcgccgtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtggcgggccacccgactacaaggacgacgatgacaaa

SEQ ID NO: 232 - protein, 418 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQGGGGSENLYFQ

SEQ ID NO: 233 - DNA, 1254 bp, Homo sapiens
tcacaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagggaggcggaggttccgagaatttatacttccag

SEQ ID NO: 234 - protein, 672 aa, Macaca fascicularis
SQVSQNCHNGSYEISVLMMDNSAFAEPLENVEDAVNEGLEIVRGRLQNAGLNVTVNASFMYSDGLIHNSGDCRSSTCEGLDLLRKISNAKRMGCVLMGPSCTYSTFQMYLDTELSYPMISAGSFGLSCDYKETLTRLMSPARKLTYFLVNFWKTNDLPFKTYSWSTSYVYKNGTESEDCFWYLNALEASVSYFSHELSFKLVLRQDKEFQDILMDHNRKSNVIVMCGDPEFLYKLKGDRAVAEDIVIILVDLFNDQYFEDNVTAPDYMKNVLVLTQSPGNSLLNSSFSRNLSPTKRDFALAYLNGILLFGHMLKTFLENGENITTPKFAHAFRNLTFEGYDGPVTLDDWGDVDSTMVLLYTSVDTKKYKVLLTYDTHVNQTNPVDMSPTFTWKNSKLPNDITDRGPQGGGGSENLYFQGGGGSGGGGSEPRGPTIKPCPPCKCPAPNLEGGPSVFIFPPKIKDVLMISLSPIVTCVVVDVSEDDPDVQISWFVNNVEVHTAQTQTHREDYNSTLRVVSALPIQHQDWMSGKAFACAVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGGGPPDYKDDDDK

SEQ ID NO: 235 - DNA, 2016 bp, Macaca fascicularis
tcacaggtgagtcagaactgccacaatggcagctatgaaatcagcgtcctgatgatggacaactcagcctttgcagagcccctggaaaacgtggaagatgcggtgaatgaggggctggaaatagtgagaggacgtctgcaaaacgctggcctaaatgtgactgtgaatgcttctttcatgtattcggatggtctgattcataactccggcgactgccggagcagcacctgtgaaggccttgacctactcaggaaaatttcaaatgcaaaacggatgggctgtgtcctcatggggccctcatgtacatactccaccttccagatgtaccttgacacagaattgagctaccccatgatctcagctggaagttttggattgtcatgtgactataaagaaaccttaaccaggctgatgtctccagctagaaagttgacatacttcttggttaacttttggaaaaccaatgatctacccttcaaaacttattcctggagcacttcgtatgtttacaagaatggtacggagtccgaggactgtttctggtaccttaacgctctggaggccagtgtttcctatttctcccacgaactcagttttaagttggtgttaagacaagataaggagtttcaggatatcttaatggaccacaacaggaaaagcaatgtgattgttatgtgtggtgatccagagttcctctacaagttgaagggtgaccgagcagtggctgaagacattgtcattattctagtggatcttttcaatgaccagtactttgaggacaatgtcacagcccctgactatatgaaaaatgtccttgttctgacgcagtctcctgggaattccctcctaaatagctctttctccaggaatctatccccaacaaaacgagactttgctcttgcctatttgaatggaatcctgctctttggacatatgctaaagacatttcttgaaaatggagaaaatattaccacccccaaatttgctcatgctttcaggaatctcacttttgaagggtatgacggtccagtgaccttggatgactggggggatgtggacagtaccatggtgcttctgtatacgtctgtggacaccaagaaatacaaggttcttttgacctatgatacccacgtaaatcagaccaaccctgtggatatgagccccacattcacttggaagaactctaaacttcctaatgatattacagaccggggccctcagggaggcggaggttccgagaatttatacttccagggcggaggcggttccggcggcggaggaagcgagccccgcggaccgacaatcaagccctgtcctccatgcaaatgcccagcacctaacctcgagggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggctttcgcatgcgccgtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtggcgggccacccgactacaaggacgacgatgacaaa

SEQ ID NO: 236 - protein, 418 aa, Macaca fascicularis
SQVSQNCHNGSYEISVLMMDNSAFAEPLENVEDAVNEGLEIVRGRLQNAGLNVTVNASFMYSDGLIHNSGDCRSSTCEGLDLLRKISNAKRMGCVLMGPSCTYSTFQMYLDTELSYPMISAGSFGLSCDYKETLTRLMSPARKLTYFLVNFWKTNDLPFKTYSWSTSYVYKNGTESEDCFWYLNALEASVSYFSHELSFKLVLRQDKEFQDILMDHNRKSNVIVMCGDPEFLYKLKGDRAVAEDIVIILVDLFNDQYFEDNVTAPDYMKNVLVLTQSPGNSLLNSSFSRNLSPTKRDFALAYLNGILLFGHMLKTFLENGENITTPKFAHAFRNLTFEGYDGPVTLDDWGDVDSTMVLLYTSVDTKKYKVLLTYDTHVNQTNPVDMSPTFTWKNSKLPNDITDRGPQGGGGSENLYFQ

SEQ ID NO: 237 - DNA, 1254 bp, Macaca fascicularis
tcacaggtgagtcagaactgccacaatggcagctatgaaatcagcgtcctgatgatggacaactcagcctttgcagagcccctggaaaacgtggaagatgcggtgaatgaggggctggaaatagtgagaggacgtctgcaaaacgctggcctaaatgtgactgtgaatgcttctttcatgtattcggatggtctgattcataactccggcgactgccggagcagcacctgtgaaggccttgacctactcaggaaaatttcaaatgcaaaacggatgggctgtgtcctcatggggccctcatgtacatactccaccttccagatgtaccttgacacagaattgagctaccccatgatctcagctggaagttttggattgtcatgtgactataaagaaaccttaaccaggctgatgtctccagctagaaagttgacatacttcttggttaacttttggaaaaccaatgatctacccttcaaaacttattcctggagcacttcgtatgtttacaagaatggtacggagtccgaggactgtttctggtaccttaacgctctggaggccagtgtttcctatttctcccacgaactcagttttaagttggtgttaagacaagataaggagtttcaggatatcttaatggaccacaacaggaaaagcaatgtgattgttatgtgtggtgatccagagttcctctacaagttgaagggtgaccgagcagtggctgaagacattgtcattattctagtggatcttttcaatgaccagtactttgaggacaatgtcacagcccctgactatatgaaaaatgtccttgttctgacgcagtctcctgggaattccctcctaaatagctctttctccaggaatctatccccaacaaaacgagactttgctcttgcctatttgaatggaatcctgctctttggacatatgctaaagacatttcttgaaaatggagaaaatattaccacccccaaatttgctcatgctttcaggaatctcacttttgaagggtatgacggtccagtgaccttggatgactggggggatgtggacagtaccatggtgcttctgtatacgtctgtggacaccaagaaatacaaggttcttttgacctatgatacccacgtaaatcagaccaaccctgtggatatgagccccacattcacttggaagaactctaaacttcctaatgatattacagaccggggccctcagggaggcggaggttccgagaatttatacttccag

SEQ ID NO: 238 - protein, 673 aa, Mus musculus
VFWASQVRQNCRNGSYEISVLMMDNSAYKEPMQNLREAVEEGLDIVRKRLREADLNVTVNATFIYSDGLIHKSGDCRSSTCEGLDLLREITRDHKMGCALMGPSCTYSTFQMYLDTELNYPMISAGSYGLSCDYKETLTRILPPARKLMYFLVDFWKVNNASFKPFSWNSSYVYKNGSEPEDCFWYLNALEAGVSYFSEVLNFKDVLRRSEQFQEILTGHNRKSNVIVMCGTPESFYDVKGDLQVAEDTVVILVDLFSNHYFEENTTAPEYMDNVLVLTLPSEQSTSNTSVAERFSSGRSDFSLAYLEGTLLFGHMLQTFLENGENVTGPKFARAFRNLTFQGFAGPVTLDDSGDIDNIMSLLYVSLDTRKYKVLMKYDTHKNKTIPVAENPNFIWKNHKLPNDVPGLGPQILMGGGGSENLYFQGGGGSGGGGSEPRGPTIKPCPPCKCPAPNLEGGPSVFIFPPKIKDVLMISLSPIVTCVVVDVSEDDPDVQISWFVNNVEVHTAQTQTHREDYNSTLRVVSALPIQHQDWMSGKAFACAVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGHHHHHH

SEQ ID NO: 239 - DNA, 2019 bp, Mus musculus
gtgttctgggcctctcaggtgaggcagaactgccgcaatggcagctacgagatcagcgtcctgatgatggacaactcagcctacaaagaacctatgcaaaacctgagggaggctgtggaggaaggactggacatagtgcgaaagcgcctgcgtgaagccgacctaaatgtgactgtgaacgcgactttcatctactccgacggtctgattcataagtcaggtgactgccggagcagcacctgtgaaggccttgacctactcagggagattacaagagatcataagatgggctgcgccctcatggggccctcgtgcacgtattccaccttccagatgtacctcgacacagagttgaactatcccatgatttccgctggaagttatggattgtcctgtgactataaggaaaccctaaccaggattctgcctccagccaggaagctgatgtacttcttggtcgatttctggaaagtcaacaatgcatctttcaaacccttttcctggaactcttcgtatgtttacaagaatggatcggaacctgaagattgtttctggtacctcaatgctctggaggctggggtgtcctatttttctgaggtgctcaacttcaaggatgtactgagacgcagcgaacagttccaggaaatcttaacaggccataacagaaagagcaatgtgattgttatgtgtggcacgccagaaagcttctatgatgtgaaaggtgacctccaagtggctgaagatactgttgtcatcctggtagatctgttcagtaaccattactttgaggagaacaccacagctcctgagtatatggacaatgtcctcgtcctgacgctgccgtctgaacagtccacctcaaacacctctgtcgccgagaggttttcatcggggagaagtgacttttctctcgcttacttggagggaaccttgctatttggacacatgctgcagacgtttcttgaaaatggagaaaatgtcacgggtcccaagtttgctcgtgcattcaggaatctcacttttcaaggctttgcaggacctgtgactctggatgacagtggggacattgacaacattatgtcccttctgtatgtgtctctggataccaggaaatacaaggttcttatgaagtatgacacccacaaaaacaaaactattccggtggctgagaaccccaacttcatctggaagaaccacaagctccccaatgacgttcctgggctgggccctcaaatcctgatgggaggcggaggttccgagaatttatacttccagggcggaggcggttccggcggcggaggaagcgagccccgcggaccgacaatcaagccctgtcctccatgcaaatgcccagcacctaacctcgagggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggctttcgcatgcgccgtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtcaccatcaccatcaccat

SEQ ID NO: 240 - protein, 425 aa, Mus musculus
VFWASQVRQNCRNGSYEISVLMMDNSAYKEPMQNLREAVEEGLDIVRKRLREADLNVTVNATFIYSDGLIHKSGDCRSSTCEGLDLLREITRDHKMGCALMGPSCTYSTFQMYLDTELNYPMISAGSYGLSCDYKETLTRILPPARKLMYFLVDFWKVNNASFKPFSWNSSYVYKNGSEPEDCFWYLNALEAGVSYFSEVLNFKDVLRRSEQFQEILTGHNRKSNVIVMCGTPESFYDVKGDLQVAEDTVVILVDLFSNHYFEENTTAPEYMDNVLVLTLPSEQSTSNTSVAERFSSGRSDFSLAYLEGTLLFGHMLQTFLENGENVTGPKFARAFRNLTFQGFAGPVTLDDSGDIDNIMSLLYVSLDTRKYKVLMKYDTHKNKTIPVAENPNFIWKNHKLPNDVPGLGPQILMGGGGSENLYFQ

SEQ ID NO: 241 - DNA, 1275 bp, Mus musculus
gtgttctgggcctctcaggtgaggcagaactgccgcaatggcagctacgagatcagcgtcctgatgatggacaactcagcctacaaagaacctatgcaaaacctgagggaggctgtggaggaaggactggacatagtgcgaaagcgcctgcgtgaagccgacctaaatgtgactgtgaacgcgactttcatctactccgacggtctgattcataagtcaggtgactgccggagcagcacctgtgaaggccttgacctactcagggagattacaagagatcataagatgggctgcgccctcatggggccctcgtgcacgtattccaccttccagatgtacctcgacacagagttgaactatcccatgatttccgctggaagttatggattgtcctgtgactataaggaaaccctaaccaggattctgcctccagccaggaagctgatgtacttcttggtcgatttctggaaagtcaacaatgcatctttcaaacccttttcctggaactcttcgtatgtttacaagaatggatcggaacctgaagattgtttctggtacctcaatgctctggaggctggggtgtcctatttttctgaggtgctcaacttcaaggatgtactgagacgcagcgaacagttccaggaaatcttaacaggccataacagaaagagcaatgtgattgttatgtgtggcacgccagaaagcttctatgatgtgaaaggtgacctccaagtggctgaagatactgttgtcatcctggtagatctgttcagtaaccattactttgaggagaacaccacagctcctgagtatatggacaatgtcctcgtcctgacgctgccgtctgaacagtccacctcaaacacctctgtcgccgagaggttttcatcggggagaagtgacttttctctcgcttacttggagggaaccttgctatttggacacatgctgcagacgtttcttgaaaatggagaaaatgtcacgggtcccaagtttgctcgtgcattcaggaatctcacttttcaaggctttgcaggacctgtgactctggatgacagtggggacattgacaacattatgtcccttctgtatgtgtctctggataccaggaaatacaaggttcttatgaagtatgacacccacaaaaacaaaactattccggtggctgagaaccccaacttcatctggaagaaccacaagctccccaatgacgttcctgggctgggccctcaaatcctgatgggaggcggaggttccgagaatttatacttccag

SEQ ID NO: 242 - protein, 214 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARGGGGSGGGGSGGGGSPIEELEDRVFVNCNTSITWVEGTVGTLLSDITRLDLGKRILDPRGIYRCNGTDIYKDKESTVQVHYRMCQSCVELDHHHHHH

SEQ ID NO: 243 - DNA, 642 bp, Homo sapiens
atgcaatccggtacgcactggagagtcttgggtctgtgccttttgtctgttggcgtatgggggcaagacgggaacgaagaaatgggaggcattacacaaacaccatacaaggtatcaattagcggcacgacggttatactgacatgtccacaatatccaggcagcgaaattctgtggcagcacaatgacaagaatattgggggagatgaagacgacaaaaatatcggtagcgacgaggaccatctgtctctgaaggaattttcagaacttgaacaatctggctattatgtgtgctacccgcgaggcagcaaaccggaagatgcaaacttttacctttatctgagagcaaggggcggcggaggctctgggggcggaggcagcggcggaggaggatcaccaatcgaggaattggaagatagggtattcgtaaattgtaacaccagcattacatgggtggaagggaccgttggaactctcctgagcgatatcacacgactggatcttggtaaacgaatcctggacccacgcggaatctatagatgtaacggaactgatatttacaaagacaaagaatctactgtgcaagttcactaccgaatgtgtcaatcatgcgttgaactcgatcaccaccaccatcatcac

SEQ ID NO: 244 - protein, 205 aa, Macaca fascicularis
MQSGTHWRVLGLCLLSVGVWGQDGNEEMGSITQTPYQVSISGTTVILTCSQHLGSEAQWQHNGKNKGDSGDQLFLPEFSEMEQSGYYVCYPRGSNPEDASHHLYLKARGGGGSGGGGSGGGGSPVEELEDRVFVKCNTSVTWVEGTVGTLLTNNTRLDLGKRILDPRGIYRCNGTDIYKDKESAVQVHYRMCQNCVELDHHHHHH

SEQ ID NO: 245 - DNA, 615 bp, Macaca fascicularis
atgcaaagcggaactcattggcgcgtcctgggactctgtctgctctccgtgggagtctggggacaagatggaaacgaagagatgggaagcattacacaaacaccataccaagtctccattagcggcactaccgtcattctgacatgttcccaacatctgggcagcgaagctcaatggcagcacaatggaaagaataagggcgatagcggagaccaactgtttctgccagaatttagcgaaatggagcaatccggctattacgtgtgctacccacgcggcagcaaccctgaagatgctagccatcacctctatctgaaggctcgcggaggcggaggcagcggcggcggaggatccggcggaggcggaagcccagtcgaggaactggaagatcgcgtcttcgtgaagtgtaacaccagcgtcacatgggtggaaggcaccgtcggaactctcctgactaacaacacacgcctggatctcggaaaacgcatcctggacccacgcggaatctatagatgtaacggaactgatatttacaaagacaaagaatccgctgtgcaagtccactaccgcatgtgtcaaaactgtgtcgaactggatcatcaccatcaccatcac

SEQ ID NO: 246 - DNA, 1386 bp, Artificial Sequence
  Synthetic nucleotide sequence
gacatccagctgacccagtctccatcctccctgtctgcatctgtaggagacagagtcaccatcacttgcagagccagtgaaagtgttgattattatggcagtagtttattgcagtggtatcagcagaaaccagggaaagcccctaagctcctgatctatgctgcatccaaactagcttctggggtcccatcaaggttcagtggcagtggatctgggacagatttcactctcaccatcagcagtctgcaacctgaagattttgcaacttactactgtcagcaaactcggaaagcgtatacgtttggccaggggaccaagctggagatcaaaggtggaggtagcgggggcggcggggaagttcaactcgttgagtctggcgggggattggttcaacccggtggaagccttagattgtcatgtgccgcctccggctttacatttagcgactattacatgacctgggtgagacaagctccaggcaaaggacttgaatgggtggcctttatcagaaatcaggcccgcggctacacaagcgaccataatccctccgtgaaaggaagatttaccatcagccgggacaatgctaaaaattcactttaccttcaaatgaactctcttagagccgaggacaccgccgtatactactgcgcaagagatagaccaagttattacgtcctggattactggggccagggaacaaccgtcaccgtgtcttctggatgcccaccgtgcccagcacctgaagccgctggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggaggagatgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtcccccggaaag

SEQ ID NO: 247 - DNA, 1398 bp, Artificial Sequence
  Synthetic nucleotide sequence
gacatccagatgacccagtccccctcttctctgtctgcctctgtgggcgacagagtgaccatcacctgcacaagctcacagtcactgtttaatgtccgcagccagaaaaactatcttgcgtggtatcagcagaagcctggcaaggctcccaagctgctgatctactgggccagtacacgagaatccggcgtgccttccagattctccggctctggctctggcaccgatttcaccctgaccatctcctccctccagcctgaggatttcgccacctactactgcaaacagtcttacgaccttttcacttttggcggcggaacaaaggtggagatcaagggcggaggtggatctggcggcggaggcgaggtgcagctggtggagtctgggggaggcttggtccagcctggggggtccctgagactctcctgtgcagcctctggcttcaccttcagcagctactggatgcactgggtccgccaggctccagggaaggggctggagtggattggagagattaaacctagcaacgaacttactaacgtccatgaaaagttcaaggaccgattcaccatctccgtggacaaggccaagaactcagcctatctgcaaatgaacagcctgagagccgaggacacggctgtgtattactgtacaagaacgattacgacgacggagggatactggttcttcgatgtctggggccaagggacactggtcaccgtctcttcaggatgtccaccgtgcccagcacctgaagccgctggggcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggaggagatgaccaagaaccaggtcagcctgtcctgcgcggtcaaaggcttctatcccagcgacatcgccgtggagtgggagagcaatgggcagccggagaacaactacaagaccacgcctcccgtgctggactccgacggctccttcttcctcgttagcaagctcaccgtggacaagagcaggtggcagcaggggaacgtcttctcatgctccgtgatgcatgaggctctgcacaaccactacacgcagaagagcctctccctgtcccccggaaag

SEQ ID NO: 248 - protein, 461 aa, Artificial Sequence
  Synthetic peptide sequence
DIQLTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 249 - protein, 464 aa, Artificial Sequence
  Synthetic peptide sequence
DIQMTQSPSSLSASVGDRVTITCTSSQSLFNVRSRKNYLAWYQQKPGKAPKLLIYWASTRESGVPSRFSGSGSGTDFTLTISSLQPEDFATYYCKQSYDLFTFGGGTKVEIKGGGSGGGGEVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 250 - protein, 925 aa, Artificial Sequence
  Synthetic peptide sequence
DIQLTQSPSSLSASVGDRVTITCRASESVDYYGTSLMQWYQQKPGKAPKLLIYAASNVESGVPSRFSGSGSGTDFTLTISSLQPEDFATYYCQQTRKVYTFGQGTKLEIKGGGSGGGGEVQLVESGGGLVQPGGSLRLSCAASGFTFSDYYMTWVRQAPGKGLEWVAFIRNRARGYTSDHNPSVKGRFTISRDNAKNSLYLQMNSLRAEDTAVYYCARDRPSYYVLDYWGQGTTVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGDIQMTQSPSSLSASVGDRVTITCTSSQSLFNVRSRKNYLAWYQQKPGKAPKLLIYWASTRESGVPSRFSGSGSGTDFTLTISSLQPEDFATYYCKQSYDLFTFGGGTKVEIKGGGSGGGGEVQLVESGGGLVQPGGSLRLSCAASGYTFTSYWMHWVRQAPGKGLEWIGEIKPSNGLTNYIEKFKNRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 251 - protein, 1073 aa, Homo sapiens
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 252 - DNA, 3850 bp, Homo sapians
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcatcctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaaaaaaaa

SEQ ID NO: 253 - protein, 1050 aa, Macaca fascicularis
SQVSQNCHNGSYEISVLMMDNSAFAEPLENVEDAVNEGLEIVRGRLQNAGLNVTVNASFMYSDGLIHNSGDCRSSTCEGLDLLRKISNAKRMGCVLMGPSCTYSTFQMYLDTELSYPMISAGSFGLSCDYKETLTRLMSPARKLTYFLVNFWKTNDLPFKTYSWSTSYVYKNGTESEDCFWYLNALEASVSYFSHELSFKLVLRQDKEFQDILMDHNRKSNVIVMCGDPEFLYKLKGDRAVAEDIVIILVDLFNDQYFEDNVTAPDYMKNVLVLTQSPGNSLLNSSFSRNLSPTKRDFALAYLNGILLFGHMLKTFLENGENITTPKFAHAFRNLTFEGYDGPVTLDDWGDVDSTMVLLYTSVDTKKYKVLLTYDTHVNQTNPVDMSPTFTWKNSKLPNDITDRGPQILMIAVFTLTGAVVLLLLVALLMLRKYKKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANVSQKGDVYSYGIIAQEIILRKETFYTSSCRDRNEKIFRVENSNGMKPFRPDLFLETAEEKELEVYLLVKSCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 254 - DNA, 3150 bp, Macaca fascicularis
tcacaggtgagtcagaactgccacaatggcagctatgaaatcagcgtcctgatgatggacaactcagcctttgcagagcccctggaaaacgtggaagatgcggtgaatgaggggctggaaatagtgagaggacgtctgcaaaacgctggcctaaatgtgactgtgaatgcttctttcatgtattcggatggtctgattcataactccggcgactgccggagcagcacctgtgaaggccttgacctactcaggaaaatttcaaatgcaaaacggatgggctgtgtcctcatggggccctcatgtacatactccaccttccagatgtaccttgacacagaattgagctaccccatgatctcagctggaagttttggattgtcatgtgactataaagaaaccttaaccaggctgatgtctccagctagaaagttgacatacttcttggttaacttttggaaaaccaatgatctacccttcaaaacttattcctggagcacttcgtatgtttacaagaatggtacggagtccgaggactgtttctggtaccttaacgctctggaggccagtgtttcctatttctcccacgaactcagttttaagttggtgttaagacaagataaggagtttcaggatatcttaatggaccacaacaggaaaagcaatgtgattgttatgtgtggtgatccagagttcctctacaagttgaagggtgaccgagcagtggctgaagacattgtcattattctagtggatcttttcaatgaccagtactttgaggacaatgtcacagcccctgactatatgaaaaatgtccttgttctgacgcagtctcctggcaattccctcctaaatagctctttctccaggaatctatccccaacaaaacgagactttgctcttgcctatttgaatggaatcctgctctttggacatatgctaaagacatttcttgaaaatggagaaaatattaccacccccaaatttgctcatgctttcaggaatctcacttttgaagggtatgacggtccagtgaccttggatgactggggggatgtggacagtaccatggtgcttctgtatacgtctgtggacaccaagaaatacaaggttcttttgacctatgatacccacgtaaatcagaccaaccctgtggatatgagccccacattcacttggaagaactctaaacttcctaatgatattacagaccggggccctcagatcctgatgattgcagtcttcaccctcaccggagctgtggtgctgctcctgcttgtcgctctcctgatgctcagaaaatataaaaaagattatgaacttcgtcagaaaaaatggtcccacattcctcctgaaaatatctttcctctggagaccaatgagaccaatcacgttagcctgaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctatggcaccgtgaaacttgataccatgatcttcggggtgatagaatactgtgagagaggatccctccgggaagttttaaatgacacaatttcctaccctgatggcacattcatggattgggagtttaagatctctgtcctgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaagacctgtggacagctccagagcacctccgccaagccaacgtctctcagaaaggagatgtgtacagctacgggatcatcgcacaggagatcatcctgcggaaagaaaccttctacacttcgagctgtcgagaccggaacgagaagattttcagagtggaaaattccaatggaatgaaacccttccgtccagatttattcttggaaacggcagaggaaaaagagctagaagtgtacctacttgtaaaaagctgttgggaagaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctatacaaggcagagagggacagggctgacagacttaactttatgttgcttccaaggctagtggtaaagtctctgaaggagaaaggctttgtagagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccattggtgatgcctacatggtggctagtggtttgcctaagagaaatggcaatcggcatgcaatagacattgccaagatggccttggaaatcctcagcttcatggggacctttgagctggagcatcttcctggcctcccaatatggattcgcattggcgttcactctggtccctgcgctgctggagttgtgggaatcaagatgcctcgttattgtctatttggagatacagtcaacacagcctctaggatggaatccactggcctccctttgaggattcatgtgagtggctccaccatagccattctgaagagaactgagtgccagttcctgtatgaagtgagaggagaaacgtacttaaagggaagaggaaatgagactacctactggctgaccgggatgaaggaccagaaattcaacctgccaacccctcctactgtggagaatcaacagcgtttgcaagcagaattttcagacatgattgccaactctttacagaaaagacaggcggcagggataagaagccaaaaacccagacgagtagccagctataaaaaaggcactctggaatacttgcaactgaataccacggacaaggagagcacctatttt

SEQ ID NO: 255 - protein, 1072 aa, Mus musculus
MTSLLGLAVRLLLFQPALMVFWASQVRQNCRNGSYEISVLMMDNSAYKEPMQNLREAVEEGLDIVRKRLREADLNVTVNATFIYSDGLIHKSGDCRSSTCEGLDLLREITRDHKMGCALMGPSCTYSTFQMYLDTELNYPMISAGSYGLSCDYKETLTRILPPARKLMYFLVDFWKVNNASFKPFSWNSSYVYKNGSEPEDCFWYLNALEAGVSYFSEVLNFKDVLRRSEQFQEILTGHNRKSNVIVMCGTPESFYDVKGDLQVAEDTVVILVDLFSNHYFEENTTAPEYMDNVLVLTLPSEQSTSNTSVAERFSSGRSDFSLAYLEGTLLFGHMLQTFLENGENVTGPKFARAFRNLTFQGFAGPVTLDDSGDIDNIMSLLYVSLDTRKYKVLMKYDTHKNKTIPVAENPNFIWKNHKLPNDVPGLGPQILMIAVFTLTGILVVLLLIALLVLRKYRRDHALRQKKWSHIPSENIFPLETNETNHISLKIDDDRRRDTIQRVRQCKYDKKKVILKDLKHSDGNFSEKQKIDLNKLLQSDYYNLTKFYGTVKLDTRIFGVVEYCERGSLREVLNDTISYPDGTFMDWEFKISVLNDIAKGMSYLHSSKIEVHGRLKSTNCVVDSRMVVKITDFGCNSILPPKKDLWTAPEHLRQATISQKGDVYSFAIIAQEIILRKETFYTLSCRDHNEKIFRVENSYGKPFRPDLFLETADEKELEVYLLVKSCWEEDPEKRPDFKKIESTLAKIFGLFHDQKNESYMDTLIRRLQLYSRNLEHLVEERTQLYKAERDRADHLNFMLLPRLVVKSLKEKGIVEPELYEEVTIYFSDIVGFTTICKYSTPMEVVDMLNDIYKSFDQIVDHHDVYKVETIGDAYVVASGLPMRNGNRHAVDISKMALDILSFIGTFELEHLPGLPVWIRIGVHSGPCAAGVVGIKMPRYCLFGDTVNTASRMESTGLPLRIHMSSSTITILKRTDCQFLYEVRGETYLKGRGTETTYWLTGMKDQEYNLPSPPTVENQQRLQTEFSDMIVSALQKRQASGKKSRRPTRVASYKKGFLEYMQLNNSDHDSTYF

SEQ ID NO: 256 - DNA, 3951 bp, Mus musculus
gaccagtgtggcaagaccagaaaggtgcgtggggaagagaagaccaagggactctgctagcgactctccagaggggctccctgtgtctctaaaagcgagcaatccaggggggcatggtgctacggtgagccaggtcatgacgtcactgctgggcttggctgtgcggttactgctcttccagcccgcgctgatggtgttctgggcctctcaggtgaggcagaactgccgcaatggcagctacgagatcagcgtcctgatgatggacaactcagcctacaaagaacctatgcaaaacctgagggaggctgtggaggaaggactggacatagtgcgaaagcgcctgcgtgaagccgacctaaatgtgactgtgaacgcgactttcatctactccgacggtctgattcataagtcaggtgactgccggagcagcacctgtgaaggccttgacctactcagggagattacaagagatcataagatgggctgcgccctcatggggccctcgtgcacgtattccaccttccagatgtacctcgacacagagttgaactatcccatgatttccgctggaagttatggattgtcctgtgactataaggaaaccctaaccaggatcctgcctccagccaggaagctgatgtacttcttggtcgatttctggaaagtcaacaatgcatctttcaaacccttttcctggaactcttcgtatgtttacaagaatggatcggaacctgaagattgtttctggtacctcaatgctctggaggctggggtgtcctatttttctgaggtgctcaacttcaaggatgtactgagacgcagcgaacagttccaggaaatcttaacaggccataacagaaagagcaatgtgattgttatgtgtggcacgccagaaagcttctatgatgtgaaaggtgacctccaagtggctgaagatactgttgtcatcctggtagatctgttcagtaaccattactttgaggagaacaccacagctcctgagtatatggacaatgtcctcgtcctgacgctgccgtctgaacagtccacctcaaacacctctgtcgccgagaggttttcatcggggagaagtgacttttctctcgcttacttggagggaaccttgctatttggacacatgctgcagacgtttcttgaaaatggagaaaatgtcacgggtcccaagtttgctcgtgcattcaggaatctcacttttcaaggctttgcaggacctgtgactctggatgacagtggggacattgacaacattatgtcccttctgtatgtgtctctggataccaggaaatacaaggttcttatgaagtatgacacccacaaaaacaaaactattccggtggctgagaaccccaacttcatctggaagaaccacaagctccccaatgacgttcctgggctgggccctcaaatcctgatgattgccgtcttcacgctcacggggatcctggtagttctgctgctgattgccctcctcgtgctgagaaaatacagaagagatcatgcacttcgacagaagaaatggtcccacattccttctgaaaacatctttcctctggagaccaacgagaccaaccacatcagcctgaagattgacgatgacaggagacgagacacaatccagagagtgcgacagtgcaaatacgacaagaagaaagtgattctgaaagacctcaagcacagcgacgggaacttcagtgagaagcagaagatagacctgaacaagttgctgcagtctgactactacaacctgactaagttctacggcaccgtgaagctggacaccaggatctttggggtggttgagtactgcgagaggggatccctccgggaagtgttaaacgacacaatttcctaccctgacggcacgttcatggattgggagtttaagatctctgtcttaaatgacatcgctaaggggatgtcctacctgcactccagtaagattgaagtccacgggcgtctcaaatccaccaactgcgtggtggacagccgcatggtggtgaagatcaccgactttgggtgcaattccatcctgcctccaaaaaaagacctgtggacggccccggagcacctgcgccaggccaccatctctcagaaaggagacgtgtacagcttcgccatcattgcccaggagatcatcctccgtaaggagactttttacacgctgagctgtcgggatcacaatgagaagattttcagagtggaaaattcatacgggaaacctttccgcccagacctcttcctggagactgcagatgagaaggagctggaggtctatctacttgtcaaaagctgttgggaggaggatccagaaaagaggccagatttcaagaaaatcgagagcacactggccaagatatttggccttttccatgaccagaaaaacgagtcttacatggacaccttgatccgacgtctccagctgtactctcgaaacctggaacatctggtggaggaaaggactcagctgtacaaggcggagagggacagggctgaccaccttaacttcatgctcctcccacggctggtggtaaagtcactgaaggagaaaggcatcgtggagccagagctgtacgaagaagtcacaatctacttcagtgacattgtgggcttcaccaccatctgcaagtatagcacgcccatggaggtggtggacatgctcaacgacatctacaagagctttgaccagattgtggaccaccatgacgtctacaaggtagaaaccatcggtgacgcctacgtggtggccagcggtctgcctatgagaaacggcaaccgacacgcggtagacatttccaagatggccttggacatcctcagcttcatagggacctttgagttggagcatctccctggcctccccgtgtggatccgcattggagttcattctgggccctgcgctgctggtgttgtggggatcaagatgcctcgctattgcctgtttggagacactgtcaacactgcctccaggatggaatccaccggcctccccttgaggattcacatgagcagctccaccataaccatcctgaagagaacggattgccagttcctgtatgaagtgaggggagaaacctacttaaagggaagagggacagagaccacatactggctgactgggatgaaggaccaagaatacaacctgccatccccaccgacagtggagaaccaacagcgtctgcagactgagttctcagacatgatcgttagcgccttacagaaaagacaggcctcgggcaagaagagccggaggcccactcgggtggccagctacaagaaaggctttctggaatacatgcagctgaacaattcagaccacgatagcacctatttttagaccaagtgaggtctgagaactgacagtagcaacctcctatatcatgaatctgtattttccagagacctcaacaacatagacaagcacttagcctcagtgccctgactggaacgtagaaccaacccctcaagtcatgtgggtctgattttgggttggttggttggttggttggttggttttggttttgttgagacagagtttcgtgtatcccaagctggtctcaaactcactgtgtagcagcagatgactttggacttctaagatcatccgtgtgtgttcctgacagtgtgatgagtgtatacgtcagagccctgtcccacagttctccatggagcatcaacctgaatggaggagcgaggagggggaatgtcctgtgctgtacagaacttggggttttgttctaattttatctctggtttggttttgttttctggctccttccctctctatgtgtgagagaagtttttaaattgtctgaattgtatgctaagtagcttatctacaagaaagtgtgtttaactagtgatttttgcagaaaccatgctggatattaggtaaaaaataaaagtgtttagagtctaaaaaaaaaaaaaaaa

SEQ ID NO: 257 - protein, 5 aa, Artificial Sequence
  Synthetic peptide sequence
TYWMQ

SEQ ID NO: 258 - protein, 5 aa, Artificial Sequence
  Synthetic peptide sequence
KYWMQ

SEQ ID NO: 259 - protein, 5 aa, Artificial Sequence
  Synthetic peptide sequence
SYWMH

SEQ ID NO: 260 - protein, 5 aa, Artificial Sequence
  Synthetic peptide sequence
DTYIH

SEQ ID NO: 261 - protein, 5 aa, Artificial Sequence
  Synthetic peptide sequence
DYIML

SEQ ID NO: 262 - protein, 6 aa, Artificial Sequence
  Synthetic peptide sequence
YPGDGM

SEQ ID NO: 263 - protein, 6 aa, Artificial Sequence
  Synthetic peptide sequence
YPGDGF

SEQ ID NO: 264 - protein, 6 aa, Artificial Sequence
  Synthetic peptide sequence
KPSNGL

SEQ ID NO: 265 - protein, 6 aa, Artificial Sequence
  Synthetic peptide sequence
DPANGN

SEQ ID NO: 266 - protein, 6 aa, Artificial Sequence
  Synthetic peptide sequence
NPYYGS

SEQ ID NO: 267 - protein, 6 aa, Artificial Sequence
  Synthetic peptide sequence
KPSNEL

SEQ ID NO: 268 - protein, 5 aa, Artificial Sequence
  Synthetic peptide sequence
DYYMT

SEQ ID NO: 269 - protein, 8 aa, Artificial Sequence
  Synthetic peptide sequence
RNRARGYT

SEQ ID NO: 270 - protein, 8 aa, Artificial Sequence
  Synthetic peptide sequence
RNQARGYT

SEQ ID NO: 271 - protein, 5 aa, Artificial Sequence
  Synthetic peptide sequence
SYWMS

SEQ ID NO: 272 - protein, 6 aa, Artificial Sequence
  Synthetic peptide sequence
KQDGSE

SEQ ID NO: 273 - protein, 121 aa, Artificial Sequence; identical to SEQ ID NO: 9
  Synthetic peptide sequence

SEQ ID NO: 274 - protein, 112 aa, Artificial Sequence
  Synthetic peptide sequence
DIQMTQSPSSLSASVGDRVTITCTSDQSLFNVRSGKNYLAWYQQKPGKAPKLLIYWASDRESGVPSRFSGSGSGTDFTLTISSLQPEDFATYYCKQSYDLFTFGGGTKVEIK

SEQ ID NO: 275 - protein, 112 aa, Artificial Sequence
  Synthetic peptide sequence
DIQMTQSPSSLSASVGDRVTITCTSSESLFNVRSGKNYLAWYQQKPGKAPKLLIYWASDRESGVPSRFSGSGSGTDFTLTISSLQPEDFATYYCKQSYDLFTFGGGTKVEIK

SEQ ID NO: 276 - protein, 112 aa, Artificial Sequence
  Synthetic peptide sequence
DIQMTQSPSSLSASVGDRVTITCTSSQSLFNVRSGKNYLAWYQQKPGKAPKLLIYWASDRESGVPSRFSGSGSGTDFTLTISSLQPEDFATYYCKQSYDLFTFGGGTKVEIK

SEQ ID NO: 277 - protein, 7 aa, Artificial Sequence
  Synthetic peptide sequence
GFTFSDY

SEQ ID NO: 278 - protein, 17 aa, Artificial Sequence
  Synthetic peptide sequence
TSDQSLFNVRSGKNYLA

SEQ ID NO: 279 - protein, 17 aa, Artificial Sequence
  Synthetic peptide sequence
TSSESLFNVRSGKNYLA

SEQ ID NO: 280 - protein, 17 aa, Artificial Sequence
  Synthetic peptide sequence
TSSQSLFNVRSGKNYLA

SEQ ID NO: 281 - protein, 7 aa, Artificial Sequence
  Synthetic peptide sequence
WASDRES

SEQ ID NO: 282 - protein, 461 aa, Artificial Sequence; identical to SEQ ID NO: 216
  Synthetic peptide sequence

SEQ ID NO: 283 - protein, 465 aa, Artificial Sequence
  Synthetic peptide sequence
DIQMTQSPSSLSASVGDRVTITCTSDQSLFNVRSGKNYLAWYQQKPGKAPKLLIYWASDRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 284 - protein, 461 aa, Artificial Sequence; identical to SEQ ID NO: 216
  Synthetic peptide sequence

SEQ ID NO: 285 - protein, 465 aa, Artificial Sequence
  Synthetic peptide sequence
DIQMTQSPSSLSASVGDRVTITCTSSQSLFNVRSGKNYLAWYQQKPGKAPKLLIYWASDRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 286 - protein, 461 aa, Artificial Sequence; identical to SEQ ID NO: 216
  Synthetic peptide sequence

SEQ ID NO: 287 - protein, 465 aa, Artificial Sequence
  Synthetic peptide sequence
DIQMTQSPSSLSASVGDRVTITCTSSESLFNVRSGKNYLAWYQQKPGKAPKLLIYWASDRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 288 - DNA, 336 bp, Artificial Sequence
  Synthetic nucleotide sequence
gacatccagatgacccagtccccctcttctctgtctgcctctgtgggcgacagagtgaccatcacctgcacaagcgaccagtcactgtttaatgtccgcagcggcaaaaactatcttgcgtggtatcagcagaagcctggcaaggctcccaagctgctgatctactgggccagtgaccgagaatccggcgtgccttccagattctccggctctggctctggcaccgatttcaccctgaccatctcctccctccagcctgaggatttcgccacctactactgcaaacagtcttacgaccttttcacttttggcggcggaacaaaggtggagatcaag

SEQ ID NO: 289 - DNA, 363 bp, Artificial Sequence
  Synthetic nucleotide sequence
gaagtgcagcttgttgaatctggcggcggtttggttcagcccggtggatcactgcgactcagttgcgcagctagcggcttcaccttttctgattactacatgacatgggtacgacaggcgccaggcaagggtttggaatgggtagcattcatacgcaatcaggcacgcgggtacacttcagaccacaatccctcagtaaaaggaagatttaccatctcaagagacaatgccaaaaattcactctacctgcaaatgaactcacttcgcgccgaggataccgccgtgtattactgtgccagagacagaccatcttattacgtgctggactattggggacagggcactacagtcaccgtcagctct

SEQ ID NO: 290 - DNA, 336 bp, Artificial Sequence
  Synthetic nucleotide sequence
gacatccagatgacccagtccccctcttctctgtctgcctctgtgggcgacagagtgaccatcacctgcacaagctcagagtcactgtttaatgtccgcagcggcaaaaactatcttgcgtggtatcagcagaagcctggcaaggctcccaagctgctgatctactgggccagtgaccgagaatccggcgtgccttccagattctccggctctggctctggcaccgatttcaccctgaccatctcctccctccagcctgaggatttcgccacctactactgcaaacagtcttacgaccttttcacttttggcggcggaacaaaggtggagatcaag

SEQ ID NO: 291 - DNA, 363 bp, Artificial Sequence; identical to SEQ ID NO: 289
  Synthetic nucleotide sequence

SEQ ID NO: 292 - DNA, 336 bp, Artificial Sequence
  Synthetic nucleotide sequence
gacatccagatgacccagtccccctcttctctgtctgcctctgtgggcgacagagtgaccatcacctgcacaagctcacagtcactgtttaatgtccgcagcggcaaaaactatcttgcgtggtatcagcagaagcctggcaaggctcccaagctgctgatctactgggccagtgaccgagaatccggcgtgccttccagattctccggctctggctctggcaccgatttcaccctgaccatctcctccctccagcctgaggatttcgccacctactactgcaaacagtcttacgaccttttcacttttggcggcggaacaaaggtggagatcaag

SEQ ID NO: 293 - DNA, 363 bp, Artificial Sequence; identical to SEQ ID NO: 289
  Synthetic nucleotide sequence

SEQ ID NO: 294 - protein, 122 aa, Artificial Sequence
  Synthetic peptide sequence
EVQLVESGGGLVQPGGSLRLSCAASGFTFSTRWMHWVRQAPGKGLEWIGEIKPSNKLTNVHEKFKDRFTISVDKAKNSAYLQMNSLRAEDTAVYYCARTITTTEGYWFLSDWGQGTLVTVSS

SEQ ID NO: 295 - protein, 110 aa, Artificial Sequence
  Synthetic peptide sequence
DIQLTQSPSSLSASVGDRVTITCRASESVDYYGHSLMQWYQQKPGKAPKLLIYAASKLASGVPSRFSGSGSGTDFTLTISSLQPEDFATYYCQQTRKAYTFGQGTKLEIK

SEQ ID NO: 296 - protein, 122 aa, Artificial Sequence
  Synthetic peptide sequence
EVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTPLGYWFFDVWGQGTLVTVSS

SEQ ID NO: 297 - protein, 110 aa, Artificial Sequence
  Synthetic peptide sequence
DIQLTQSPSSLSASVGDRVTITCRASESVDYYGSSLMQWYQQKPGKAPKLLIYAASKLASGVPSRFSGSGSGTDFTLTISSLQPEDFATYYCQQTRKAYTFGQGTKLEIK

SEQ ID NO: 298 - protein, 122 aa, Artificial Sequence; identical to SEQ ID NO: 296
  Synthetic peptide sequence

SEQ ID NO: 299 - protein, 110 aa, Artificial Sequence; identical to SEQ ID NO: 297
  Synthetic peptide sequence

SEQ ID NO: 300 - protein, 122 aa, Artificial Sequence
  Synthetic peptide sequence
EVQLVESGGGLVQPGGSLRLSCAASGFTFSSYWMHWVRQAPGKGLEWIGEIKPSNRWNNVHEKFKDRFTISVDKAKNSAYLQMNSLRAEDTAVYYCTRTITTTEGYWFFDVWGQGTLVTVSS

SEQ ID NO: 301 - protein, 110 aa, Artificial Sequence; identical to SEQ ID NO: 297
  Synthetic peptide sequence

SEQ ID NO: 302 - protein, 122 aa, Artificial Sequence
  Synthetic peptide sequence
EVQLVESGGGLVQPGGSLRLSCAASGFTFSSYWMHWVRQAPGKGLEWIGEIKPSRGFTNVHEKFKDRFTISVDKAKNSAYLQMNSLRAEDTAVYYCTRTITTTEGYWFFDVWGQGTLVTVSS

SEQ ID NO: 303 - protein, 110 aa, Artificial Sequence; identical to SEQ ID NO: 297
  Synthetic peptide sequence

SEQ ID NO: 304 - protein, 122 aa, Artificial Sequence
  Synthetic peptide sequence
EVQLVESGGGLVQPGGSLRLSCAASGFTFSSTWMHWVRQAPGKGLEWIGEIKPSNELTNVHEKFKDRFTISVDKAKNSAYLQMNSLRAEDTAVYYCTRTITTTEGYWFFDVWGQGTLVTVSS

SEQ ID NO: 305 - protein, 110 aa, Artificial Sequence; identical to SEQ ID NO: 297
  Synthetic peptide sequence

SEQ ID NO: 306 - protein, 122 aa, Artificial Sequence
  Synthetic peptide sequence
EVQLVESGGGLVQPGGSLRLSCAASGFTFSRPWMHWVRQAPGKGLEWIGEIKPSTGWTNVHEKFKDRFTISVDKAKNSAYLQMNSLRAEDTAVYYCTRTITTTTGYWFFDVWGQGTLVTVSS

SEQ ID NO: 307 - protein, 110 aa, Artificial Sequence
  Synthetic peptide sequence
DIQLTQSPSSLSASVGDRVTITCRASESVDYYKHSLMQWYQQKPGKAPKLLIYAASKLASGVPSRFSGSGSGTDFTLTISSLQPEDFATYYCQQTRKAYTFGQGTKLEIK

SEQ ID NO: 308 - protein, 122 aa, Artificial Sequence
  Synthetic peptide sequence
EVQLVESGGGLVQPGGSLRLSCAASGFTFSSYWMHWVRQAPGKGLEWIGEIKPSRGWTNVHEKFKDRFTISVDKAKNSAYLQMNSLRAEDTAVYYCARTITTTEGYWFFDVWGQGTLVTVSS

SEQ ID NO: 309 - protein, 110 aa, Artificial Sequence
  Synthetic peptide sequence
DIQLTQSPSSLSASVGDRVTITCRASESVDYYRHSLMQWYQQKPGKAPKLLIYAASKLASGVPSRFSGSGSGTDFTLTISSLQPEDFATYYCQQTRKAYTFGQGTKLEIK

SEQ ID NO: 310 - protein, 122 aa, Artificial Sequence
  Synthetic peptide sequence
EVQLVESGGGLVQPGGSLRLSCAASGFTFSHTWMHWVRQAPGKGLEWIGEIKPSRGFTNVHEKFKDRFTISVDKAKNSAYLQMNSLRAEDTAVYYCTRTITTTQGYWFFDVWGQGTLVTVSS

SEQ ID NO: 311 - protein, 110 aa, Artificial Sequence
  Synthetic peptide sequence
DIQLTQSPSSLSASVGDRVTITCRASESVNWYGSSLMQWYQQKPGKAPKLLIYAASKLASGVPSRFSGSGSGTDFTLTISSLQPEDFATYYCQQTRKAYTFGQGTKLEIK

SEQ ID NO: 312 - protein, 122 aa, Artificial Sequence
  Synthetic peptide sequence
EVQLVESGGGLVQPGGSLRLSCAASGFTFSHTWMHWVRQAPGKGLEWIGEIKPSTKYTNVHEKFKDRFTISVDKAKNSAYLQMNSLRAEDTAVYYCARTIFTREGYWFFDVWGQGTLVTVSS

SEQ ID NO: 313 - protein, 110 aa, Artificial Sequence; identical to SEQ ID NO: 311
  Synthetic peptide sequence

SEQ ID NO: 314 - protein, 122 aa, Artificial Sequence
  Synthetic peptide sequence
EVQLVESGGGLVQPGGSLRLSCAASGFTFSSYWMHWVRQAPGKGLEWIGEIKPSTKYTNVHEKFKDRFTISVDKAKNSAYLQMNSLRAEDTAVYYCTRTIFTNEGYWFFDVWGQGTLVTVSS

SEQ ID NO: 315 - protein, 110 aa, Artificial Sequence
  Synthetic peptide sequence
DIQLTQSPSSLSASVGDRVTITCRASESVSIYGSSLMQWYQQKPGKAPKLLIYAASKLASGVPSRFSGSGSGTDFTLTISSLQPEDFATYYCQQTRKAYTFGQGTKLEIK

SEQ ID NO: 316 - protein, 20 aa, Artificial Sequence
  Synthetic peptide sequence
MKTLLLDLALWSLLFQPGWL

SEQ ID NO: 317 - protein, 20 aa, Artificial Sequence
  Synthetic peptide sequence
LDLALWSLLFQPGWLSFSSQ

SEQ ID NO: 318 - protein, 20 aa, Artificial Sequence
  Synthetic peptide sequence
WSLLFQPGWLSFSSQVSQNC

SEQ ID NO: 319 - protein, 20 aa, Artificial Sequence
  Synthetic peptide sequence
QPGWLSFSSQVSQNCHNGSY

SEQ ID NO: 320 - protein, 20 aa, Artificial Sequence
  Synthetic peptide sequence
SFSSQVSQNCHNGSYEISVL

SEQ ID NO: 321 - protein, 20 aa, Artificial Sequence
  Synthetic peptide sequence
VSQNCHNGSYEISVLMMGNS

SEQ ID NO: 322 - protein, 20 aa, Artificial Sequence
  Synthetic peptide sequence
HNGSYEISVLMMGNSAFAEP

SEQ ID NO: 323 - protein, 20 aa, Artificial Sequence
  Synthetic peptide sequence
EISVLMMGNSAFAEPLKNLE

SEQ ID NO: 324 - protein, 20 aa, Artificial Sequence
  Synthetic peptide sequence
MMGNSAFAEPLKNLEDAVNE

SEQ ID NO: 325 - protein, 20 aa, Artificial Sequence
  Synthetic peptide sequence
AFAEPLKNLEDAVNEGLEIV

SEQ ID NO: 326 - protein, 20 aa, Artificial Sequence
  Synthetic peptide sequence
LKNLEDAVNEGLEIVRGRLQ

SEQ ID NO: 327 - protein, 20 aa, Artificial Sequence
  Synthetic peptide sequence
DAVNEGLEIVRGRLQNAGLN

SEQ ID NO: 328 - protein, 20 aa, Artificial Sequence
  Synthetic peptide sequence
GLEIVRGRLQNAGLNVTVNA

SEQ ID NO: 329 - protein, 20 aa, Artificial Sequence
  Synthetic peptide sequence
RGRLQNAGLNVTVNATFMYS

SEQ ID NO: 330 - protein, 20 aa, Artificial Sequence
  Synthetic peptide sequence
NAGLNVTVNATFMYSDGLIH

SEQ ID NO: 331 - protein, 20 aa, Artificial Sequence
  Synthetic peptide sequence
VTVNATFMYSDGLIHNSGDC

SEQ ID NO: 332 - protein, 20 aa, Artificial Sequence
  Synthetic peptide sequence
TFMYSDGLIHNSGDCRSSTC

SEQ ID NO: 333 - protein, 20 aa, Artificial Sequence
  Synthetic peptide sequence
DGLIHNSGDCRSSTCEGLDL

SEQ ID NO: 334 - protein, 20 aa, Artificial Sequence
  Synthetic peptide sequence
NSGDCRSSTCEGLDLLRKIS

SEQ ID NO: 335 - protein, 20 aa, Artificial Sequence
  Synthetic peptide sequence
RSSTCEGLDLLRKISNAQRM

SEQ ID NO: 336 - protein, 20 aa, Artificial Sequence
  Synthetic peptide sequence
EGLDLLRKISNAQRMGCVLI

SEQ ID NO: 337 - protein, 20 aa, Artificial Sequence
  Synthetic peptide sequence
LRKISNAQRMGCVLIGPSCT

SEQ ID NO: 338 - protein, 20 aa, Artificial Sequence
  Synthetic peptide sequence
NAQRMGCVLIGPSCTYSTFQ

SEQ ID NO: 339 - protein, 20 aa, Artificial Sequence
  Synthetic peptide sequence
GCVLIGPSCTYSTFQMYLDT

SEQ ID NO: 340 - protein, 20 aa, Artificial Sequence
  Synthetic peptide sequence
GPSCTYSTFQMYLDTELSYP

SEQ ID NO: 341 - protein, 20 aa, Artificial Sequence
  Synthetic peptide sequence
YSTFQMYLDTELSYPMISAG

SEQ ID NO: 342 - protein, 20 aa, Artificial Sequence
  Synthetic peptide sequence
MYLDTELSYPMISAGSFGLS

SEQ ID NO: 343 - protein, 20 aa, Artificial Sequence
  Synthetic peptide sequence
ELSYPMISAGSFGLSCDYKE

SEQ ID NO: 344 - protein, 20 aa, Artificial Sequence
  Synthetic peptide sequence
MISAGSFGLSCDYKETLTRL

SEQ ID NO: 345 - protein, 20 aa, Artificial Sequence
  Synthetic peptide sequence
SFGLSCDYKETLTRLMSPAR

SEQ ID NO: 346 - protein, 20 aa, Artificial Sequence
  Synthetic peptide sequence
CDYKETLTRLMSPARKLMYF

SEQ ID NO: 347 - protein, 20 aa, Artificial Sequence
  Synthetic peptide sequence
TLTRLMSPARKLMYFLVNFW

SEQ ID NO: 348 - protein, 20 aa, Artificial Sequence
  Synthetic peptide sequence
MSPARKLMYFLVNFWKTNDL

SEQ ID NO: 349 - protein, 20 aa, Artificial Sequence
  Synthetic peptide sequence
KLMYFLVNFWKTNDLPFKTY

SEQ ID NO: 350 - protein, 20 aa, Artificial Sequence
  Synthetic peptide sequence
LVNFWKTNDLPFKTYSWSTS

SEQ ID NO: 351 - protein, 20 aa, Artificial Sequence
  Synthetic peptide sequence
KTNDLPFKTYSWSTSYVYKN

SEQ ID NO: 352 - protein, 20 aa, Artificial Sequence
  Synthetic peptide sequence
PFKTYSWSTSYVYKNGTETE

SEQ ID NO: 353 - protein, 20 aa, Artificial Sequence
  Synthetic peptide sequence
SWSTSYVYKNGTETEDCFWY

SEQ ID NO: 354 - protein, 20 aa, Artificial Sequence
  Synthetic peptide sequence
YVYKNGTETEDCFWYLNALE

SEQ ID NO: 355 - protein, 20 aa, Artificial Sequence
  Synthetic peptide sequence
GTETEDCFWYLNALEASVSY

SEQ ID NO: 356 - protein, 20 aa, Artificial Sequence
  Synthetic peptide sequence
DCFWYLNALEASVSYFSHEL

SEQ ID NO: 357 - protein, 20 aa, Artificial Sequence
  Synthetic peptide sequence
LNALEASVSYFSHELGFKVV

SEQ ID NO: 358 - protein, 20 aa, Artificial Sequence
  Synthetic peptide sequence
ASVSYFSHELGFKVVLRQDK

SEQ ID NO: 359 - protein, 20 aa, Artificial Sequence
  Synthetic peptide sequence
FSHELGFKVVLRQDKEFQDI

SEQ ID NO: 360 - protein, 20 aa, Artificial Sequence
  Synthetic peptide sequence
GFKVVLRQDKEFQDILMDHN

SEQ ID NO: 361 - protein, 20 aa, Artificial Sequence
  Synthetic peptide sequence
LRQDKEFQDILMDHNRKSNV

SEQ ID NO: 362 - protein, 20 aa, Artificial Sequence
  Synthetic peptide sequence
EFQDILMDHNRKSNVIIMCG

SEQ ID NO: 363 - protein, 20 aa, Artificial Sequence
  Synthetic peptide sequence
LMDHNRKSNVIIMCGGPEFL

SEQ ID NO: 364 - protein, 20 aa, Artificial Sequence
  Synthetic peptide sequence
RKSNVIIMCGGPEFLYKLKG

SEQ ID NO: 365 - protein, 20 aa, Artificial Sequence
  Synthetic peptide sequence
IIMCGGPEFLYKLKGDRAVA

SEQ ID NO: 366 - protein, 20 aa, Artificial Sequence
  Synthetic peptide sequence
GPEFLYKLKGDRAVAEDIVI

SEQ ID NO: 367 - protein, 20 aa, Artificial Sequence
  Synthetic peptide sequence
YKLKGDRAVAEDIVIILVDL

SEQ ID NO: 368 - protein, 20 aa, Artificial Sequence
  Synthetic peptide sequence
DRAVAEDIVIILVDLFNDQY

SEQ ID NO: 369 - protein, 20 aa, Artificial Sequence
  Synthetic peptide sequence
EDIVIILVDLFNDQYLEDNV

SEQ ID NO: 370 - protein, 20 aa, Artificial Sequence
  Synthetic peptide sequence
ILVDLFNDQYLEDNVTAPDY

SEQ ID NO: 371 - protein, 20 aa, Artificial Sequence
  Synthetic peptide sequence
FNDQYLEDNVTAPDYMKNVL

SEQ ID NO: 372 - protein, 20 aa, Artificial Sequence
  Synthetic peptide sequence
LEDNVTAPDYMKNVLVLTLS

SEQ ID NO: 373 - protein, 20 aa, Artificial Sequence
  Synthetic peptide sequence
TAPDYMKNVLVLTLSPGNSL

SEQ ID NO: 374 - protein, 20 aa, Artificial Sequence
  Synthetic peptide sequence
MKNVLVLTLSPGNSLLNSSF

SEQ ID NO: 375 - protein, 20 aa, Artificial Sequence
  Synthetic peptide sequence
MKNVLVLTLSPGNSLLNSSF

SEQ ID NO: 376 - protein, 20 aa, Artificial Sequence
  Synthetic peptide sequence
VLTLSPGNSLLNSSFSRNLS

SEQ ID NO: 377 - protein, 20 aa, Artificial Sequence
  Synthetic peptide sequence
PGNSLLNSSFSRNLSPTKRD

SEQ ID NO: 378 - protein, 20 aa, Artificial Sequence
  Synthetic peptide sequence
LNSSFSRNLSPTKRDFALAY

SEQ ID NO: 379 - protein, 20 aa, Artificial Sequence
  Synthetic peptide sequence
SRNLSPTKRDFALAYLNGIL

SEQ ID NO: 380 - protein, 20 aa, Artificial Sequence
  Synthetic peptide sequence
PTKRDFALAYLNGILLFGHM

SEQ ID NO: 381 - protein, 20 aa, Artificial Sequence
  Synthetic peptide sequence
FALAYLNGILLFGHMLKIFL

SEQ ID NO: 382 - protein, 20 aa, Artificial Sequence
  Synthetic peptide sequence
LNGILLFGHMLKIFLENGEN

SEQ ID NO: 383 - protein, 20 aa, Artificial Sequence
  Synthetic peptide sequence
LFGHMLKIFLENGENITTPK

SEQ ID NO: 384 - protein, 20 aa, Artificial Sequence
  Synthetic peptide sequence
LKIFLENGENITTPKFAHAF

SEQ ID NO: 385 - protein, 20 aa, Artificial Sequence
  Synthetic peptide sequence
ENGENITTPKFAHAFRNLTF

SEQ ID NO: 386 - protein, 20 aa, Artificial Sequence
  Synthetic peptide sequence
ITTPKFAHAFRNLTFEGYDG

SEQ ID NO: 387 - protein, 20 aa, Artificial Sequence
  Synthetic peptide sequence
FAHAFRNLTFEGYDGPVTLD

SEQ ID NO: 388 - protein, 20 aa, Artificial Sequence
  Synthetic peptide sequence
RNLTFEGYDGPVTLDDWGDV

SEQ ID NO: 389 - protein, 20 aa, Artificial Sequence
  Synthetic peptide sequence
EGYDGPVTLDDWGDVDSTMV

SEQ ID NO: 390 - protein, 20 aa, Artificial Sequence
  Synthetic peptide sequence
PVTLDDWGDVDSTMVLLYTS

SEQ ID NO: 391 - protein, 20 aa, Artificial Sequence
  Synthetic peptide sequence
DWGDVDSTMVLLYTSVDTKK

SEQ ID NO: 392 - protein, 20 aa, Artificial Sequence
  Synthetic peptide sequence
DSTMVLLYTSVDTKKYKVLL

SEQ ID NO: 393 - protein, 20 aa, Artificial Sequence
  Synthetic peptide sequence
LLYTSVDTKKYKVLLTYDTH

SEQ ID NO: 394 - protein, 20 aa, Artificial Sequence
  Synthetic peptide sequence
VDTKKYKVLLTYDTHVNKTY

SEQ ID NO: 395 - protein, 20 aa, Artificial Sequence
  Synthetic peptide sequence
YKVLLTYDTHVNKTYPVDMS

SEQ ID NO: 396 - protein, 20 aa, Artificial Sequence
  Synthetic peptide sequence
TYDTHVNKTYPVDMSPTFTW

SEQ ID NO: 397 - protein, 20 aa, Artificial Sequence
  Synthetic peptide sequence
VNKTYPVDMSPTFTWKNSKL

SEQ ID NO: 398 - protein, 20 aa, Artificial Sequence
  Synthetic peptide sequence
PVDMSPTFTWKNSKLPNDIT

SEQ ID NO: 399 - protein, 20 aa, Artificial Sequence
  Synthetic peptide sequence
PTFTWKNSKLPNDITGRGPQ

SEQ ID NO: 400 - protein, 20 aa, Artificial Sequence
  Synthetic peptide sequence
KNSKLPNDITGRGPQILMIA

SEQ ID NO: 401 - protein, 20 aa, Artificial Sequence
  Synthetic peptide sequence
PNDITGRGPQILMIAVFTLT

SEQ ID NO: 402 - protein, 20 aa, Artificial Sequence
  Synthetic peptide sequence
LRKISNAQRMGCVLIGPSCT

SEQ ID NO: 403 - protein, 20 aa, Artificial Sequence
  Synthetic peptide sequence
NAQRMGCVLIGPSCTYSTFQ

SEQ ID NO: 404 - protein, 20 aa, Artificial Sequence
  Synthetic peptide sequence
GCVLIGPSCTYSTFQMYLDT

SEQ ID NO: 405 - protein, 25 aa, Artificial Sequence
  Synthetic peptide sequence
NSGDCRSSTCEGLDLLRKISNAQRM

SEQ ID NO: 406 - protein, 15 aa, Artificial Sequence
  Synthetic peptide sequence
RSSTCEGLDLLRKIS

SEQ ID NO: 407 - protein, 254 aa, Artificial Sequence
  Synthetic peptide sequence
DIQMTQSPSSLSASVGDRVTITCTSSQSLFNVRSQKNYLAWYQQKPGKAPKLLIYWASTRESGVPSRFSGSGSGTDFTLTISSLQPEDFATYYCKQSYDLFTFGGGTKVEIKGGGGSGGGGEVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGGCGGHHHHHH

SEQ ID NO: 408 - protein, 252 aa, Artificial Sequence
  Synthetic peptide sequence
DIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKGGGSGGGGEVQLVESGGGLVQPGGSLRLSCAASGFTFSDYYMTWVRQAPGKGLEWVAFIRNQARGYTSDHNPSVKGRFTISRDNAKNSLYLQMNSLRAEDTAVYYCARDRPSYYVLDYWGQGTTVTVSSGGCGGDYKDDDDK

SEQ ID NO: 409 - protein, 257 aa, Artificial Sequence
  Synthetic peptide sequence
EVQLVESGGGLVQPGGSLRLSCAASGFTFSSYWMHWVRQAPGKGLEWIGEIKPSNELTNVHEKFKDRFTISVDKAKNSAYLQMNSLRAEDTAVYYCTRTITTTEGYWFFDVWGQGTLVTVSSGGGGSGGGGSGGGGSGDIQLTQSPSSLSASVGDRVTITCRASESVDYYGSSLLQWYQQKPGKAPKLLIYAASKLASGVPSRFSGSGSGTDFTLTISSLQPEDFATYYCQQTRKAYTFGQGTKLEIKTGSENLYFQ

SEQ ID NO: 410 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 411 - protein, 1030 aa, Artificial Sequence
  Synthetic peptide sequence
MQLLRCFSIFSVIASVLAQEGKPIPNPLLGLDSTGGGSGGGAQAAGAHSSQVRQKCHNGTYEISVLMMDNSAYKEPLQNLRDAVEEGLDIVRKRLREAELNVTVNATFIYSDGLIHKSGDCRSSTCEGLDLLREITRDRKMGCVLMGPSCTYSTFQMYLDTELNYPMISAGSFGLSCDYKETLTRILPPARKLMYFLVDFWKVNNAPFKTFSWNSSYVYKNGSEPEDCFWYLNALEAGVSYFSEVLSFKDVLRRSEQFQEILMGRNRKSNVIVMCGTPETFYNVKGDLKVADDTVVILVDLFSNHYFEDDTRAPEYMDNVLVLTLPPEKFIANASVSGRFPSERSDFSLAYLEGTLLFGHMLQTFLENGESVTTPKFARAFRNLTFQGLEGPVTLDDSGDIDNIMCLLYVSLDTRKYKVLMAYDTHKNQTIPVATSPNFIWKNHRLPNDVPGLGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 412 - protein, 1028 aa, Artificial Sequence
  Synthetic peptide sequence
MQLLRCFSIFSVIASVLAQEGKPIPNPLLGLDSTGGGSGGGAQAAGAHSSSRCNNNNYMINVMLMPDSDFPSTSENLTSAVEEALSTIQNELETEGVKVTVNASFHHFRSSLYVSQGCRTSTCEGVELIKQIFENGTLGCAVIGPACTYATYQMVSVETIPSLPLISVGSFGLSCDYKENLTRLLTPARKVNDFFYYFWNEIQQPFKTSTWESVYLYKKTDNSEQCLWYMNALDAGVTQFSEKLKFKDIVRTQDQFRRLVKNPKRKSNVIIMCGTPADIRQDLGTETVDKDIVIILIDLFKNTYFRNTTSARYMQNVLVLTLPPANNNFSTRTTDTSLLEDDFVIGYYNAVLLFGHILKKFIFSQSPVLPTSFINEFRNITFEGAQGPVTLDEFGDIDNNLTLLYTTQSASDPQYRVLMYFNTQENDTYVVSTSPDFIWKSHRLPSDIPSTGPHRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 413 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEINVLMMGNSAFAEPLKNLEDAVNEGLEIVRGRLQNAGLNVTVNATFMYFDGLLHNSGDCRSSTCEGVDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 414 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGDSDFAEPLKNLEDAVNEGLEIVRGRLQNAGLNVTVNATFMYSDGLIHNSGGCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 415 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMVLDTELSYPMISAGSFGLSCDYKENLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 416 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYTWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITSRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 417 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFRDILMDHNRKSNVIIMCGGPAFLYKLKGTRAVAEDIVIILVDLFNDQYFRDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 418 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHEFRNITFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 419 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRTSTCEGVELIKQIFENGTLGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 420 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWNEIQQPFKTSTWESSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 421 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKKTDNSEQCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 422 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELKFKDIVRTQKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 423 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDDQFRRLVKNPKRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 424 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGTETVDKDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 425 - protein, 1029 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFRNTTSARYMQNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 426 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSASDPQYRVLMYFNTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 427 - protein, 1028 aa, Artificial Sequence
  Synthetic peptide sequence
MQLLRCFSIFSVIASVLAQEGKPIPNPLLGLDSTGGGSGGGAQAAGAHSSSRCNNNNYMINVMLMPDSDFPSTSENLTSAVEEALSTIQNELETEGVKVTVNASFHHFRSSLYVSQGCRSSTCEGLDLLRKISNAQRMGCAVIGPACTYATYQMVSVETIPSLPLISVGSFGLSCDYKENLTRLLTPARKVNDFFYYFWNEIQQPFKTSTWESVYLYKKTDNSEQCLWYMNALDAGVTQFSEKLKFKDIVRTQDQFRRLVKNPKRKSNVIIMCGTPADIRQDLGTETVDKDIVIILIDLFKNTYFRNTTSARYMQNVLVLTLPPANNNFSTRTTDTSLLEDDFVIGYYNAVLLFGHILKKFIFSQSPVLPTSFINEFRNITFEGAQGPVTLDEFGDIDNNLTLLYTTQSASDPQYRVLMYFNTQENDTYVVSTSPDFIWKSHRLPSDIPSTGPHRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 428 - protein, 1028 aa, Artificial Sequence
  Synthetic peptide sequence
MQLLRCFSIFSVIASVLAQEGKPIPNPLLGLDSTGGGSGGGAQAAGAHSSSRCNNNNYMINVMLMPDSDFPSTSENLTSAVEEALSTIQNELETEGVKVTVNASFHHFRSSLYVSQGCRSSTCEGLDLLRKISENGTLGCAVIGPACTYATYQMVSVETIPSLPLISVGSFGLSCDYKENLTRLLTPARKVNDFFYYFWNEIQQPFKTSTWESVYLYKKTDNSEQCLWYMNALDAGVTQFSEKLKFKDIVRTQDQFRRLVKNPKRKSNVIIMCGTPADIRQDLGTETVDKDIVIILIDLFKNTYFRNTTSARYMQNVLVLTLPPANNNFSTRTTDTSLLEDDFVIGYYNAVLLFGHILKKFIFSQSPVLPTSFINEFRNITFEGAQGPVTLDEFGDIDNNLTLLYTTQSASDPQYRVLMYFNTQENDTYVVSTSPDFIWKSHRLPSDIPSTGPHRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 429 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEINVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 430 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYFDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 431 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLLHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 432 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRTSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 433 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGVDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 434 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLELLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 435 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLIRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 436 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLKKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 437 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRQISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 438 - protein, 1030 aa, Artificial Sequence
  Synthetic peptide sequence
MQLLRCFSIFSVIASVLAQEGKPIPNPLLGLDSTGGGSGGGAQAAGAHSSQVSQNCHNGSYEISVLMMGNSAFAEPLKNLEDAVNEGLEIVRGRLQNAGLNVTVNATFMYSDGLIHNSGDCRSSTCEGLDLLRKIFNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQRTSDQASGAHHHHHHGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 439 - protein, 617 aa, Artificial Sequence
  Synthetic peptide sequence
MQLLRCFSIFSVIASVLAQEGKPIPNPLLGLDSTGGGSGGGAQAAGAHSRTSDQASGAGAYPYDVPDYAGHGTSGGGGSGGTSTPSYTTSIISTETPSHSTPSSSTSITTTETPSHSTPSYTSSVSTSETTSHSTPSETSSSRTTESTSYSSPSSTSSNTITETSSHSTPSTATSISSTETPSSSIPSVSSSITVTESSSHSTPGATSTLTSSETSTWSTPSSTSSIMSSSYTSADTPSETSVYTSSETPSSSSPTSTSLISSSKSTSTSTPSFTSSITSTETSSYSASSYTPSVSSTASSSKNTTSSTASISSAETVSSSSSSVSSTIPSSQSTSYSTPSFSSSATSSVTPLHSTPSLPSWVTTSKTTSHITPGLTSSMSSSETYSHSTPGFTSSITSTESTSESTPSLSSSTIYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHKLQGDSGETIGKYIGAADSLGGSVLLLALAPLVLLSLL

SEQ ID NO: 440 - protein, 214 aa, Artificial Sequence
  Synthetic peptide sequences
DIVLTQSPASLAVSLGQRATISCRASESVDYYGTSLMQWYQQKPGQPPKLLIYAASNVESGVPARFSGSGSGTDFSLNIHPVEEDDIAMYFCQQTRKVYTFGGGTKLEIKGDPVAPTVLIFPPAADQVATGTVTIVCVANKYFPDVTVTWEVDGTTQTTGIENSKTPQNSADCTYNLSSTLTLTSTQYNSHKEYTCRVTQGTTSVVQSFNRGDC

SEQ ID NO: 441 - protein, 445 aa, Artificial Sequence
  Synthetic peptide sequence
QVQLQQPGAELVKPGASVKLSCKASGYTFTSYWMHWVKQRPGQGLEWIGEIKPSNGLTNYIEKFKNKATLTVDKSATTAYMQLSSLTAEDSAVYYCTRTITTTEGYWFFDVWGAGTTVTVSSGQPKAPSVFPLAPCCGDTPSSTVTLGCLVKGYLPEPVTVTWNSGTLTNGVRTFPSVRQSSGLYSLSSVVSVTSSSQPVTCNVAHPATNTKVDKTVAPSTCSKPTCPPPELLGGPSVFIFPPKPKDTLMISRTPEVTCVVVDVSQDDPEVQFTWYINNEQVRTARPPLREQQFNSTIRVVSTLPIAHQDWLRGKEFKCKVHNKALPAPIEKTISKARGQPLEPKVYTMGPPREELSSRSVSLTCMINGFYPSDISVEWEKNGKAEDNYKTTPAVLDSDGSYFLYSKLSVPTSEWQRGDVFTCSVMHEALHNHYTQKSISRSPGK

SEQ ID NO: 442 - protein, 217 aa, Artificial Sequence
  Synthetic peptide sequence
DIVLTQSPASLAVSLGQRATISCRASESVDYYGTSLMQWYQQKPGQPPKLLIYAASNVESGVPARFSGSGSGTDFSLNIHPVEEDDIAMYFCQQTRKVYTFGGGTKLEIKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 443 - protein, 446 aa, Artificial Sequence
  Synthetic peptide sequence
QVQLQQPGAELVKPGASVKLSCKASGYTFTSYWMHWVKQRPGQGLEWIGEIKPSNGLTNYIEKFKNKATLTVDKSATTAYMQLSSLTAEDSAVYYCTRTITTTEGYWFFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 444 - protein, 217 aa, Artificial Sequence
  Synthetic peptide sequence
DIVLTQSPASLAVSLGQRATISCRASESVDYYGTSLMQWYQQKPGQPPKLLIYAASNVESGVPARFSGSGSGTDFSLNIHPVEEDDIAMYFCQQTRKVYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 445 - protein, 451 aa, Artificial Sequence
  Synthetic peptide sequence
QVQLQQPGAELVKPGASVKLSCKASGYTFTSYWMHWVKQRPGQGLEWIGEIKPSNGLTNYIEKFKNKATLTVDKSATTAYMQLSSLTAEDSAVYYCTRTITTTEGYWFFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

What is claimed is:

1. A bispecific antibody that specifically binds to GUCY2c and CD3, wherein the bispecific antibody comprises a first polypeptide chain and a second polypeptide chain, wherein:
   a. (i) the first polypeptide chain comprises, in the N-terminal to C-terminal direction: a Domain 1, comprising a VL region of a GUCY2c antibody (a GUCY2c VL), and a VH region of a CD3 antibody (a CD3 VH), and a first heterodimer-promoting domain; and
      (ii) the second polypeptide chain comprises, in the N-terminal to C-terminal direction: a Domain 2, comprising a VL region of a CD3 antibody (a CD3 VL), and a VH region of a GUCY2c antibody (a GUCY2c VH), and a second heterodimer-promoting domain;
   b. (i) the first polypeptide chain comprises, in the N-terminal to C-terminal direction: a Domain 1, comprising a CD3 VL, and a GUCY2c VH, and a first heterodimer-promoting domain; and
      (ii) the second polypeptide chain comprises, in the N-terminal to C-terminal direction: a Domain 2, comprising a Gucy2c VL, and a CD3 VH, and a second heterodimer-promoting domain;
   c. (i) the first polypeptide chain comprises, in the N-terminal to C-terminal direction: a Domain 1, comprising a GUCY2c VH, and a CD3 VL, and a first heterodimer-promoting domain; and
      (ii) the second polypeptide chain comprises, in the N-terminal to C-terminal direction: a Domain 2, comprising a CD3 VH, and a Gucy2c VL, and a second heterodimer-promoting domain;
   or
   d. (i) the first polypeptide chain comprises, in the N-terminal to C-terminal direction: a Domain 1, comprising a CD3 VH, and a Gucy2c VL, and a first heterodimer-promoting domain; and
      (ii) the second polypeptide chain comprises, in the N-terminal to C-terminal direction: a Domain 2, comprising a Gucy2c VH, and a CD3 VL, and a second heterodimer-promoting domain;
and wherein the GUCY2c VL and the GUCY2c VH form a domain that specifically binds to GUCY2c; and the CD3 VL and the CD3 VH form a domain that specifically binds to CD3, and wherein
the GUCY2c VH comprises (i) a GUCY2c VH CDR1 comprising the amino acid sequence of SEQ ID NO: 74 or 259, (ii) a GUCY2c VH CDR2 comprising the amino acid sequence of SEQ ID NO: 75 or 267, and (iii) a GUCY2c VH CDR3 comprising the amino acid sequence of SEQ ID NO: 29;
the GUCY2c VL comprises (i) a GUCY2c VL CDR1 comprising the amino acid sequence of SEQ ID NO: 148, (ii) a GUCY2c VL CDR2 comprising the amino acid sequence of SEQ ID NO: 149, and (iii) a GUCY2c VL CDR3 comprising the amino acid sequence of SEQ ID NO: 142;
the CD3 VH comprises (i) a CD3 VH CDR1 comprising the amino acid sequence of SEQ ID NO: 2 or 268, (ii) a CD3 VH CDR2 comprising the amino acid sequence of SEQ ID NO: 10 or 270, and (iii) a CD3 VH CDR3 comprising the amino acid sequence of SEQ ID NO: 4; and
the CD3 VL comprises (i) a CD3 VL CDR1 comprising the amino acid sequence of SEQ ID NO: 91, (ii) a CD3 VL CDR2 comprising the amino acid sequence of SEQ ID NO: 78, and (iii) a CD3 VL CDR3 comprising the amino acid sequence of SEQ ID NO: 79.

2. The bispecific antibody of claim 1, wherein the first heterodimer-promoting domain and the second heterodimer-promoting domain each comprise an Fc region comprising a CH2 domain and a CH3 domain, wherein the amino acid sequence of each of the CH2 domain and/or the CH3 comprises at least one amino acid modification as compared to wildtype Fc region, to form a knob or a hole.

3. The bispecific antibody of claim 2, wherein the first heterodimer-promoting domain and the second heterodimer-promoting domain are not both knobs or both holes; and/or wherein the first heterodimer-promoting domain and the second heterodimer-promoting domain form an IgG immunoglobulin Fc region.

4. The bispecific antibody of claim 1, wherein the GUCY2c VL and the CD3 VH are linked by a glycine-serine linker; and the CD3 VL and the GUCY2c VH are linked by a glycine-serine linker.

5. The bispecific antibody of claim 1, wherein Domain 1 is covalently bound to the first heterodimer-promoting domain via a cysteine linker; and Domain 2 is covalently bound to the second heterodimer-promoting domain via a cysteine linker; wherein the cysteine linker comprises at least five amino acids.

6. The bispecific antibody of claim 1, wherein:
   (i) the first polypeptide chain comprises, in the N-terminal to C-terminal direction: Domain 1, comprising the VL region of the GUCY2c antibody (the GUCY2c VL), and the VH region of the CD3 antibody (the CD3 VH), and the first heterodimer-promoting domain; and
   (ii) the second polypeptide chain comprises, in the N-terminal to C-terminal direction: Domain 2, comprising the VL region of the CD3 antibody (the CD3 VL), and a VH region of the GUCY2c antibody (the GUCY2c VH), and the second heterodimer-promoting domain;
and wherein
the GUCY2c VH comprises (i) the GUCY2c VH CDR1 comprising the amino acid sequence of SEQ ID NO: 259, (ii) the GUCY2c VH CDR2 comprising the amino acid sequence of SEQ ID NO: 75, and (iii) the GUCY2c VH CDR3 comprising the amino acid sequence of SEQ ID NO: 29;

the GUCY2c VL comprises (i) the GUCY2c VL CDR1 comprising the amino acid sequence of SEQ ID NO: 148, (ii) the GUCY2c VL CDR2 comprising the amino acid sequence of SEQ ID NO: 149, and (iii) the GUCY2c VL CDR3 comprising the amino acid sequence of SEQ ID NO: 142;

the CD3 VH comprises (i) the CD3 VH CDR1 comprising the amino acid sequence of SEQ ID NO: 268, (ii) the CD3 VH CDR2 comprising the amino acid sequence of SEQ ID NO: 10, and (iii) the CD3 VH CDR3 comprising the amino acid sequence of SEQ ID NO: 4; and the CD3 VL comprises (i) the CD3 VL CDR1 comprising the amino acid sequence of SEQ ID NO: 91, (ii) the CD3 VL CDR2 comprising the amino acid sequence of SEQ ID NO: 78, and (iii) the CD3 VL CDR3 comprising the amino acid sequence of SEQ ID NO: 79.

7. The bispecific antibody of claim 1, wherein:
  (i) the first polypeptide chain comprises, in the N-terminal to C-terminal direction: Domain 1, comprising the VL region of the GUCY2c antibody (the GUCY2c VL), and the VH region of the CD3 antibody (the CD3 VH), and the first heterodimer-promoting domain; and
  (ii) the second polypeptide chain comprises, in the N-terminal to C-terminal direction: Domain 2, comprising the VL region of the CD3 antibody (the CD3 VL), and a VH region of the GUCY2c antibody (the GUCY2c VH), and the second heterodimer-promoting domain; and wherein the GUCY2c VH comprises (i) the GUCY2c VH CDR1 comprising the amino acid sequence of SEQ ID NO: 74, (ii) the GUCY2c VH CDR2 comprising the amino acid sequence of SEQ ID NO: 75, and (iii) the GUCY2c VH CDR3 comprising the amino acid sequence of SEQ ID NO: 29;

the GUCY2c VL comprises (i) the GUCY2c VL CDR1 comprising the amino acid sequence of SEQ ID NO: 148, (ii) the GUCY2c VL CDR2 comprising the amino acid sequence of SEQ ID NO: 149, and (iii) the GUCY2c VL CDR3 comprising the amino acid sequence of SEQ ID NO: 142;

the CD3 VH comprises (i) the CD3 VH CDR1 comprising the amino acid sequence of SEQ ID NO: 2, (ii) the CD3 VH CDR2 comprising the amino acid sequence of SEQ ID NO: 10, and (iii) the CD3 VH CDR3 comprising the amino acid sequence of SEQ ID NO: 4; and the CD3 VL comprises (i) the CD3 VL CDR1 comprising the amino acid sequence of SEQ ID NO: 91, (ii) the CD3 VL CDR2 comprising the amino acid sequence of SEQ ID NO: 78, and (iii) the CD3 VL CDR3 comprising the amino acid sequence of SEQ ID NO: 79.

8. The bispecific antibody of claim 1, wherein:
  a. the GUCY2c VH comprises the amino acid sequence of SEQ ID NO: 73; and
  b. the GUCY2c VL comprises the amino acid sequence of SEQ ID NO: 147.

9. The bispecific antibody of claim 1, wherein:
  a. the CD3 VH comprises the amino acid sequence of SEQ ID NO: 9;
  b. the CD3 VL comprises the amino acid sequence of SEQ ID NO: 90;
  c. the GUCY2c VH comprises the amino acid sequence of SEQ ID NO: 73; and
  d. the GUCY2c VL comprises the amino acid sequence of SEQ ID NO: 147.

10. A bispecific antibody that specifically binds to GUCY2c and CD3, wherein the bispecific antibody comprises a first polypeptide chain and a second polypeptide chain, and wherein:
  a. the first polypeptide chain comprises the following regions in the following order in an N-terminal to C-terminal direction:
  a VL of a GUCY2c antibody (a GUCY2c VL)—Linker 1—a VH of a CD3 antibody (a CD3 VH)—Linker 3—a first heterodimer-promoting domain, wherein the GUCY2c VL comprises the amino acid sequence of SEQ ID NO: 147, Linker 1 comprises the amino acid sequence of SEQ ID NO: 190, the CD3 VH comprises the amino acid sequence of SEQ ID NO: 9, Linker 3 comprises the amino acid sequence of SEQ ID NO: 192, and the first heterodimer-promoting domain comprises the amino acid sequence of SEQ ID NO: 188; and
  b. the second polypeptide chain comprises the following regions in the following order in an N-terminal to C-terminal direction:
  a VL of a CD3 antibody (a CD3 VL)—Linker 2—a VH of a GUCY2c antibody (a GUCY2c VH)—Linker 3—a second heterodimer-promoting domain, wherein the CD3 VL comprises the amino acid sequence of SEQ ID NO: 90, Linker 2 comprises the amino acid sequence of SEQ ID NO: 191, the GUCY2c VH comprises the amino acid sequence of SEQ ID NO: 73, Linker 3 comprises the amino acid sequence of SEQ ID NO: 192, and the second heterodimer-promoting domain comprises the amino acid sequence of SEQ ID NO: 189.

11. The bispecific antibody of claim 10, wherein the GUCY2c VL and the GUCY2c VH form a domain that specifically binds to GUCY2c; and the CD3 VL and the CD3 VH form a domain that specifically binds to CD3; wherein Linker 3 of the first polypeptide chain and Linker 3 of the second polypeptide chain are covalently bound to one another by two disulfide bonds; wherein the first heterodimer-promoting domain and the second heterodimer-promoting domain each comprise a CH2 domain and a CH3 domain; wherein the CH3 domain of the first heterodimer-promoting domain forms a knob, and the CH3 domain of the second heterodimer-promoting domain forms a hole; and wherein at least one disulfide bond is formed between the CH3 domain of the first heterodimer-promoting domain and the CH3 domain of the second heterodimer-promoting domain.

12. The bispecific antibody of claim 1, wherein the bispecific antibody is a humanized antibody.

13. A bispecific antibody that specifically binds to GUCY2c and CD3, wherein the bispecific antibody comprises a first polypeptide chain and a second polypeptide chain; wherein the first polypeptide chain is produced by the expression vector with ATCC Accession No. PTA-124944; and the second polypeptide chain is produced by the expression vector with ATCC Accession No. PTA-124943.

14. A bispecific antibody that specifically binds to GUCY2c and to CD3 comprising a first polypeptide chain and a second polypeptide chain, wherein the first polypeptide chain comprises the amino acid sequence of SEQ ID NO: 216 and the second polypeptide chain comprises the amino acid sequence of SEQ ID NO: 220.

15. A method of treating a GUCY2c associated cancer in a patient in need thereof, comprising administering to the patient the bispecific antibody of claim 1, or a pharmaceutical composition comprising the bispecific antibody of claim 1.

16. A polynucleotide comprising a nucleotide sequence encoding the bispecific antibody of claim 1.

17. A vector comprising the polynucleotide of claim 16.

18. A host cell comprising the vector of claim 17.

19. A method of producing the bispecific antibody of claim 1, comprising culturing the host cell of claim 18, under conditions that result in production of the bispecific antibody of claim 1, and purifying the bispecific antibody of claim 1 from the culture supernatant.

20. A composition comprising the bispecific antibody of claim 1 and a second therapeutic agent.

21. A method for treating a cancer in a subject comprising administering to the subject a combination therapy which comprises the composition of claim 20.

22. A composition comprising the bispecific antibody of claim 1 and an antidiarrheal agent.

23. A method for treating a cancer in a subject comprising administering to the subject a combination therapy which comprises the composition of claim 22.

24. A pharmaceutical composition comprising the bispecific antibody of claim 1.

\* \* \* \* \*